United States Patent
Fitzgerald et al.

(10) Patent No.: US 11,319,539 B2
(45) Date of Patent: May 3, 2022

(54) XANTHINE DEHYDROGENASE (XDH) IRNA COMPOSITIONS AND METHODS OF USE THEREOF

(71) Applicant: Alnylam Pharmaceuticals, Inc., Cambridge, MA (US)

(72) Inventors: Kevin Fitzgerald, Brookline, MA (US); Gregory Hinkle, Plymouth, MA (US); Timothy Ryan Mooney, Cambridge, MA (US)

(73) Assignee: Alnylam Pharmaceuticals, Inc., Cambridge, MA (US)

( * ) Notice: Subject to any disclaimer, the term of this patent is extended or adjusted under 35 U.S.C. 154(b) by 0 days.

(21) Appl. No.: 16/752,742

(22) Filed: Jan. 27, 2020

(65) Prior Publication Data
US 2020/0299698 A1 Sep. 24, 2020

Related U.S. Application Data

(63) Continuation of application No. 15/747,571, filed as application No. PCT/US2016/043985 on Jul. 26, 2016, now abandoned.

(60) Provisional application No. 62/287,522, filed on Jan. 27, 2016, provisional application No. 62/255,603, filed on Nov. 16, 2015, provisional application No. 62/197,221, filed on Jul. 27, 2015.

(51) Int. Cl.
*C12N 15/113* (2010.01)
*A61K 9/00* (2006.01)
*A61K 31/713* (2006.01)
*A61K 47/14* (2017.01)

(52) U.S. Cl.
CPC ........ *C12N 15/1137* (2013.01); *A61K 9/0019* (2013.01); *A61K 31/713* (2013.01); *A61K 47/14* (2013.01); *C12N 2310/14* (2013.01); *C12N 2310/315* (2013.01); *C12N 2310/3125* (2013.01); *C12N 2310/321* (2013.01); *C12N 2310/322* (2013.01); *C12N 2310/335* (2013.01); *C12N 2310/351* (2013.01); *C12N 2310/3515* (2013.01)

(58) Field of Classification Search
CPC .......... C12N 15/1137; C12N 2310/322; C12N 2310/335; C12N 2310/3515; C12N 2310/3125; C12N 2310/351; C12N 2310/14; C12N 2310/315; C12N 2310/321; A61K 9/0019; A61K 31/713; A61K 47/14
See application file for complete search history.

(56) References Cited

U.S. PATENT DOCUMENTS

| 8,106,022 | B2 | 1/2012 | Manoharan et al. | |
|---|---|---|---|---|
| 2008/0113351 | A1* | 5/2008 | Naito | A61P 35/00 435/6.11 |
| 2011/0046206 | A1 | 2/2011 | Bhat et al. | |
| 2018/0216114 | A1 | 8/2018 | Fitzgerald et al. | |

FOREIGN PATENT DOCUMENTS

| CN | 104232644 A | 12/2014 | |
|---|---|---|---|
| EP | 1752536 A1 | 2/2007 | |
| WO | WO-2006040357 A2 | 4/2006 | |
| WO | WO-2012118911 A1 * | 9/2012 | ........ A61P 7/10 |
| WO | WO-2017019660 A1 | 2/2017 | |

OTHER PUBLICATIONS

U.S. Appl. No. 15/747,571, filed Jan. 25, 2018, Abandoned.
International Search Report and Written Opinion from PCT/US2016/043985 dated Oct. 31, 2016.
Reynolds et al., "Rational siRNA design for RNA interference," Nature Biotechnology, vol. 22, pp. 326-330, 2004.

* cited by examiner

*Primary Examiner* — J. E. Angell
(74) *Attorney, Agent, or Firm* — McCarter & English, LLP; Maria Laccotripe Zacharakis; Deborah L. Nagle

(57) ABSTRACT

The present invention relates to RNAi agents, e.g., double stranded RNAi agents, targeting a xanthine dehydrogenase (XDH) gene, and methods of using such double stranded RNAi agents to inhibit expression of an XDH gene and methods of treating subjects having an XDH-associated disease.

20 Claims, 1 Drawing Sheet
Specification includes a Sequence Listing.

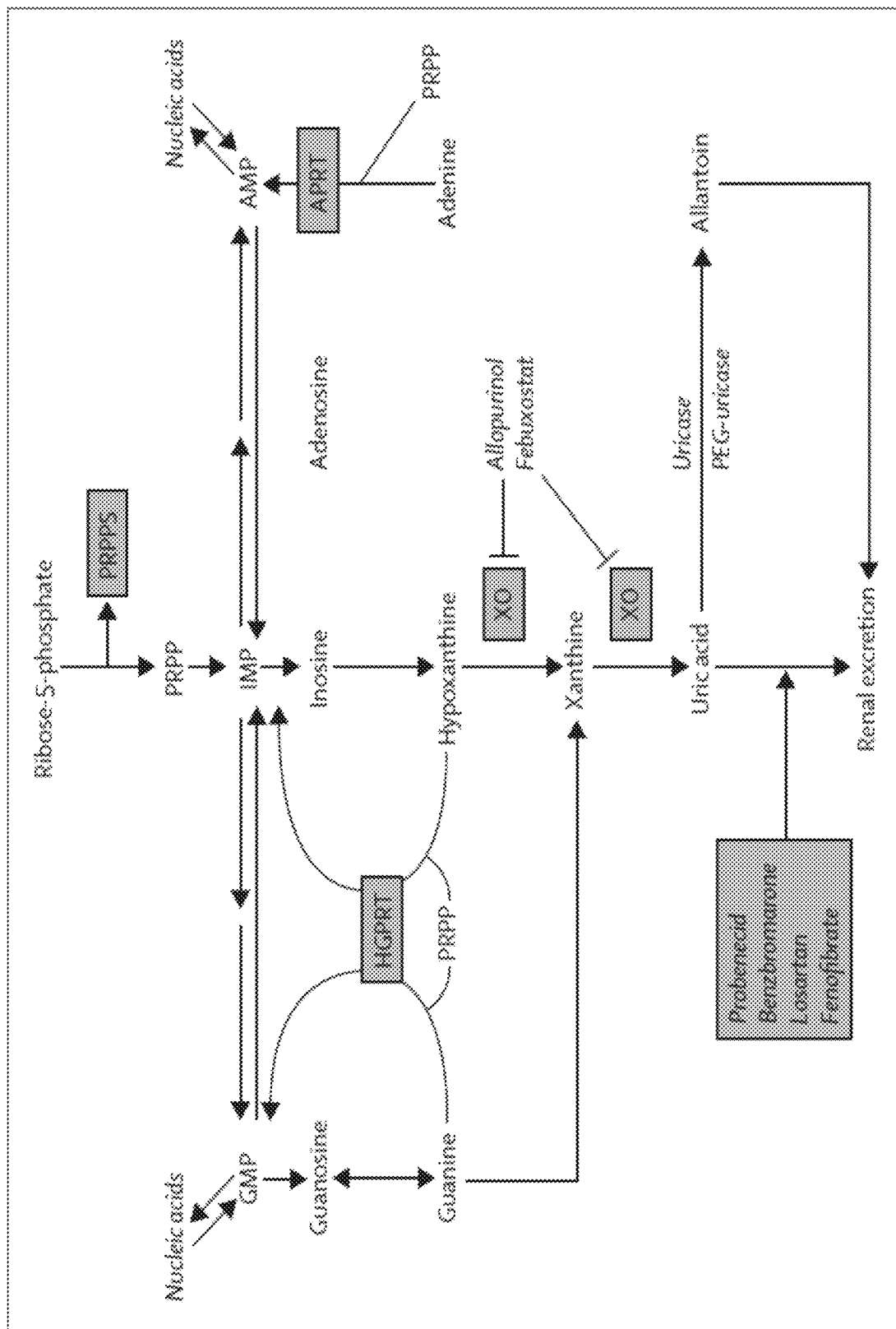

XANTHINE DEHYDROGENASE (XDH) IRNA COMPOSITIONS AND METHODS OF USE THEREOF

RELATED APPLICATIONS

This application is a continuation of U.S. patent application Ser. No. 15/747,571, filed on Jan. 25, 2018, which is a 35 U.S.C. § 371 national stage filing of International Application No. PCT/US2016/043985, filed on Jul. 26, 2016, which in turn claims the benefit of priority to U.S. Provisional Application No. 62/287,522, filed on Jan. 27, 2016, U.S. Provisional Application No. 62/255,603, filed on Nov. 16, 2015, and U.S. Provisional Application No. 62/197,221, filed on Jul. 27, 2015. The entire contents of each of the foregoing applications are hereby incorporated herein by reference.

SEQUENCE LISTING

The instant application contains a Sequence Listing which has been submitted electronically in ASCII format and is hereby incorporated by reference in its entirety. The ASCII copy, created on Jan. 10, 2020, is named 121301_04005_SL.txt and is 600,559 bytes in size.

BACKGROUND OF THE INVENTION

Reduced renal clearance of uric acid is the result of a number of factors, including defects in uric acid transporter proteins such as SLC2A9, ABCG2, and others; reduced renal excretion due to renal disease, hypothyroidism, volume contraction and volume depletion, acidosis, lead intoxication, and familial nephropathy due to uromodulin deposits; and altered renal clearance due to hyperinsulinemia or insulin resistance in diabetes. Increased synthesis of uric acid is associated with hyperuricemia plus hyperuricosuria; inborn errors of metabolism such as Lesch Nyhan/HPRT deficiency, PRPP synthetase overactivity, and glucose-6-phosphate dehydrogenase deficiency (Von Gierke disease/Glycogen Storage Disease Type Ia); certain situations of high cell turnover (e.g., tumor lysis syndrome); certain situtations of high ATP turnover (e.g., glycogen storage diseases, tissue ischemia). Furthermore, conditions such as chronic kidney disease, hypertension, metabolic syndrome, and high fructose intake may result in both increased uric acid synthesis and decreased uric acid clearance.

Chronic elevated serum uric acid (chronic hyperuricemia), typically defined as serum urate levels greater than 6.8 mg/dl (greater than 360 mmol/), the level above which the physiological saturation threshold is exceeded (Mandell, *Cleve. Clin. Med.* 75: S5-S8, 2008), is associated with a number of diseases. For example, gout is characterized by recurrent attacks of acute inflammatory arthritis that is caused by an inflammatory reaction to uric acid crystals in the joint typically due to insufficient renal clearance of uric acid or excessive uric acid production. Fructose associated gout is associated with variants of transporters expressed in the kidney, intestine, and liver. Chronic elevated uric acid is also associated with non-alcoholic steatohepatitis (NASH), non-alcoholic fatty liver disease (NAFLD), metabolic disorder, cardiovascular disease, type 2 diabetes, and conditions linked to oxidative stress, chronic low grade inflammation, and insulin resistance (Xu et al., *J. Hepatol.* 62:1412-1419, 2015; Cardoso et al., *J. Pediatr.* 89:412-418, 2013; Sertoglu et al., *Clin. Biochem.*, 47:383-388, 2014).

Uric acid (also referred to herein as urate) is the final metabolite of endogenous and dietary purine metabolism. Xanthine oxidase (XO) (EC 1.1.3.22) and xanthine dehydrogenase (XDH) (EC 1.17.1.4), which catalyze the oxidation of hypoxanthine to xanthine, and xanthine to uric acid, respectively, are interconvertible forms of the same enzyme. The enzymes are molybdopterin-containing flavoproteins that consist of two identical subunits of approximately 145 kDa. The enzyme from mammalian sources, including man, is synthesized as the dehydrogenase form, but it can be readily converted to the oxidase form by oxidation of sulfhydryl residues or by proteolysis. XDH is primarily expressed in the intestine and the liver, but it is also expressed in other tissues including adipose tissue.

Allopurinol and febuxostat (Uloric®), inhibitors of the XDH form of the enzyme, are commonly used for the treatment of gout. However, their use is contraindicated in patients with co-morbidities common to gout, especially decreased renal function, e.g., due to chronic kidney disease or hepatic impairment. Their use may also be limited in patients with metabolic syndrome, hypertension, dyslipidemia, non-alcoholic steatohepatitis (NASH) or non-alcoholic fatty liver disease (NAFLD), cardiovascular disease, or diabetes (either type 1 or type 2), due to limited organ function from the disease or condition, or due to adverse drug interactions with agents used for the treatment of such conditions.

Currently, treatments for gout do not fully meet patient needs. Therefore, there is a need for additional therapies for subjects that would benefit from reduction in the expression of an XDH gene, such as a subject having an XDH-associated disease or disorder, e.g., gout.

SUMMARY OF THE INVENTION

The present invention provides iRNA compositions which affect the RNA-induced silencing complex (RISC)-mediated cleavage of RNA transcripts of an XDH gene. The XDH gene may be within a cell, e.g., a cell within a subject, such as a human.

In an aspect, the invention provides a double stranded ribonucleic acid (dsRNA) agent for inhibiting expression of a xanthine dehydrogenase (XDH) gene, wherein the dsRNA agent comprises a sense strand and an antisense strand, wherein the sense strand comprises at least 15 contiguous nucleotides differing by no more than 3 nucleotides from the nucleotide sequence of SEQ ID NO:1 or 9 and the antisense strand comprises at least 15 contiguous nucleotides differing by no more than 3 nucleotides from the nucleotide sequence of SEQ ID NO:2 or 10, respectively.

In certain embodiments, the sense strand and antisense strand independently comprise sequences selected from the group consisting of any one of the sequences in any one of Tables 3, 4, 6, and 7.

In an aspect, the invention provides a double stranded ribonucleic acid (dsRNA) agent for inhibiting expression of xanthine dehydrogenase (XDH), wherein the dsRNA agent comprises a sense strand and an antisense strand, the antisense strand comprising a region of complementarity which comprises at least 15 contiguous nucleotides differing by no more than 3 nucleotides from any one of the antisense sequences listed in any one of Tables 3, 4, 6, and 7.

In certain embodiments, the dsRNA agent comprises at least one nucleotide comprising a nucleotide modification. In one embodiment, substantially all of the nucleotides of the sense strand comprise a modification. In another embodiment, substantially all of the nucleotides of the antisense strand comprise a modification. In yet another embodiment, substantially all of the nucleotides of the sense strand and substantially all of the nucleotides of the antisense strand comprise a modification. In one embodiment, all of the nucleotides of the sense strand comprise a modification. In another embodiment, all of the nucleotides of the antisense strand comprise a modification. In some embodiments, all of the nucleotides of the sense strand and all of the nucleotides of the antisense strand comprise a nucleotide modification.

In an aspect, the invention provides a double stranded ribonucleic acid (dsRNA) agent for inhibiting expression of a xanthine dehydrogenase (XDH) gene, wherein the dsRNA agent comprises a sense strand and an antisense strand forming a double stranded region, wherein the sense strand comprises at least 15 contiguous nucleotides differing by no more than 3 nucleotides from the nucleotide sequence of SEQ ID NO:1 or 9 and the antisense strand comprises at least 15 contiguous nucleotides differing by no more than 3 nucleotides from the nucleotide sequence of SEQ ID NO:2 or 10, respectively, wherein substantially all of the nucleotides of the sense strand and substantially all of the nucleotides of the antisense strand comprise a nucleotide modification, and wherein the sense strand is conjugated to a ligand attached at the 3'-terminus.

In certain embodiments, the present invention provides double stranded ribonucleic acid (dsRNA) agents for inhibiting expression of a XDH gene, which comprise a sense strand and an antisense strand forming a double stranded region, wherein the sense strand comprises at least 15 contiguous nucleotides differing by no more than 3 nucleotides from any one of nucleotides 490-512, 86-104, 273-291, 339-358, 410-428, 444-462, 490-509, 493-512, 888-907, 936-954, 969-987, 1105-1123, 1158-1176, 1242-1260, 1326-1344, 1357-1412, 1357-1379, 1357-1376, 1360-1379, 1378-1412, 1378-1396, 1394-1412, 1481-1499, 1515-1548, 1515-1533, 1530-1548, 1718-1736, 1783-1802, 1854-1890, 1854-1872, 1872-1890, 2053-2072, 2077-2096, 2137-2160, 2137-2156, 2142-2160, 2173-2206, 2173-2192, 2177-2195, 2184-2203, 2187-2206, 2314-2332, 2567-2604, 2567-2585, 2585-2604, 2620-2640, 2620-2639, 2621-2640, 2722-2740, 2891-2909, 2941-2975, 2941-2959, 2956-2975, 2993-3011, 3025-3061, 3025-3044, 3042-3061, 3062-3110, 3062-3080, 3079-3097, 3091-3110, 3112-3147, 3112-3130, 3129-3147, 3197-3215, 3247-3265, 3316-3334, 3366-3384, 3487-3520, 3487-3505, 3502-3520, 3606-3624, 3672-3690, 3891-3930, 3891-3910, 3893-3912, 3912-3930, 4063-4081, 4114-4132, 4152-4171, 4200-4218, 4300-4337, 4300-4319, 4303-4321, 4319-4337, 4386-4404, 4519-4538, 4541-4559, 4618-4637, or 4703-4722 of the nucleotide sequence of SEQ ID NO:1.

In certain embodiments, the present invention provides double stranded ribonucleic acid (dsRNA) agents for inhibiting expression of a XDH gene, which comprise a sense strand and an antisense strand forming a double stranded region, wherein the sense strand comprises at least 15 contiguous nucleotides of any one of nucleotides 490-512, 86-104, 273-291, 339-358, 410-428, 444-462, 490-509, 493-512, 888-907, 936-954, 969-987, 1105-1123, 1158-1176, 1242-1260, 1326-1344, 1357-1412, 1357-1379, 1357-1376, 1360-1379, 1378-1412, 1378-1396, 1394-1412, 1481-1499, 1515-1548, 1515-1533, 1530-1548, 1718-1736, 1783-1802, 1854-1890, 1854-1872, 1872-1890, 2053-2072, 2077-2096, 2137-2160, 2137-2156, 2142-2160, 2173-2206, 2173-2192, 2177-2195, 2184-2203, 2187-2206, 2314-2332, 2567-2604, 2567-2585, 2585-2604, 2620-2640, 2620-2639, 2621-2640, 2722-2740, 2891-2909, 2941-2975, 2941-2959, 2956-2975, 2993-3011, 3025-3061, 3025-3044, 3042-3061, 3062-3110, 3062-3080, 3079-3097, 3091-3110, 3112-3147, 3112-3130, 3129-3147, 3197-3215, 3247-3265, 3316-3334, 3366-3384, 3487-3520, 3487-3505, 3502-3520, 3606-3624, 3672-3690, 3891-3930, 3891-3910, 3893-3912, 3912-3930, 4063-4081, 4114-4132, 4152-4171, 4200-4218, 4300-4337, 4300-4319, 4303-4321, 4319-4337, 4386-4404, 4519-4538, 4541-4559, 4618-4637, or 4703-4722 of the nucleotide sequence of SEQ ID NO: 1.

In certain embodiments, the sense strand and the antisense strand comprise a region of complementarity which comprises at least 15 contiguous nucleotides differing by no more than 3 nucleotides from any one of the antisense sequences listed in any one of Tables 3, 4, 6, and 7. For example, in certain embodiments, the sense strand and the antisense strand comprise a region of complementarity which comprises at least 15 contiguous nucleotides differing by no more than 3 nucleotides from any one of the antisense sequences of any one of the duplexes in any one of Tables 3, 4, 6 and 7. In certain embodiments, the sense strand and the antisense strand comprise a region of complementarity which comprises at least 15 contiguous nucleotides of any one of the antisense sequences of the duplexes any one of the duplexes in any one of Tables 3, 4, 6 and 7.

For example, in certain embodiments, the sense strand and the antisense strand comprise a region of complementarity which comprises at least 15 contiguous nucleotides differing by no more than 3 nucleotides from any one of the antisense nucleotide sequences selected from the group consisting of the antisense nucleotide sequence of any of of duplexes AD-70016, AD-70033, AD-70053, AD-70050, AD-70051, AD-72007, AD-71990, AD-70049, AD-71993, AD-70042, AD-70052, AD-70018, AD-70055, AD-71831, AD-71810, AD-70023, AD-70035, AD-70044, AD-71820, AD-70027, AD-70034, AD-71837, AD-71861, AD-71998, AD-70020, AD-70026, AD-70030, AD-71801, AD-72003, AD-70025, AD-70021, AD-70029, AD-71834, AD-71765, AD-70043, AD-71840, AD-72006, AD-71844, AD-71779, AD-71830, AD-71952, AD-71766, AD-71950, AD-70022, AD-71833, AD-71823, AD-71847, AD-71900, AD-72014, AD-72015, AD-70037, AD-71982, AD-71787, AD-71894, AD-70048, AD-71887, AD-70028, AD-71980, AD-71826, AD-71855, AD-71778, AD-71757, AD-72012, AD-71854, AD-71890, AD-70038, AD-71865, AD-71933, AD-71942, AD-71901, AD-71878, AD-71905, and AD-71914.

In certain embodiments, the sense and antisense nucleotide sequences of a dsRNA agent of the invention are selected from the group consisting of a duplex selected from the group consisting of duplexes AD-70016, AD-70033, AD-70053, AD-70050, AD-70051, AD-72007, AD-71990, AD-70049, AD-71993, AD-70042, AD-70052, AD-70018, AD-70055, AD-71831, AD-71810, AD-70023, AD-70035, AD-70044, AD-71820, AD-70027, AD-70034, AD-71837, AD-71861, AD-71998, AD-70020, AD-70026, AD-70030, AD-71801, AD-72003, AD-70025, AD-70021, AD-70029, AD-71834, AD-71765, AD-70043, AD-71840, AD-72006, AD-71844, AD-71779, AD-71830, AD-71952, AD-71766, AD-71950, AD-70022, AD-71833, AD-71823, AD-71847, AD-71900, AD-72014, AD-72015, AD-70037, AD-71982, AD-71787, AD-71894, AD-70048, AD-71887, AD-70028, AD-71980, AD-71826, AD-71855, AD-71778, AD-71757, AD-72012, AD-71854, AD-71890, AD-70038, AD-71865, AD-71933, AD-71942, AD-71901, AD-71878, AD-71905, and AD-71914. In certain embodiments, the sense strand and the antisense strand comprise a region of complementarity which comprises at least 15 contiguous nucleotides of any one of the sense and antisense nucleotide sequences of any one of the foregoing duplexes.

In some embodiments, all of the nucleotides of the sense strand and all of the nucleotides of the antisense strand comprise a nucleotide modification. In one embodiment, the modified nucleotides are independently selected from the group consisting of a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxyl-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic. In another embodiment, the modified nucleotides comprise a short sequence of 3'-terminal deoxy-thymine nucleotides (dT), e.g., 1, 2, or 3 3'-terminal deoxy-thymine nucleotides (dT). In one embodiment, the modified nucleotides comprise two 3'-terminal deoxy-thymine nucleotides (dT) In certain embodiments, substantially all of the nucleotides of the sense strand are modified.

In certain embodiments, substantially all of the nucleotides of the antisense strand are modified. In certain embodiments, substantially all of the nucleotides of both the sense strand and the antisense strand are modified.

In certain embodiments, the duplex comprises, or consists of, a modified antisense strand nucleotide sequence provided in any one of Tables 4 and 7. In certain embodiments, the duplex comprises a modified sense strand nucleotide sequence provided in Table 4. In certain embodiments, the duplex comprises any one of the modified sense strand and antisense strand nucleotide sequences of a duplex provided in any one of Tables 4 and 7.

In certain embodiments, the region of complementarity between the antisense strand and the target is at least 17 nucleotides in length. For example, the region of complementarity between the antisense strand and the target is 19 to 21 nucleotides in length, for example, the region of complementarity is 21 nucleotides in length. In preferred embodiments, each strand is no more than 30 nucleotides in length.

In some embodiments, at least one strand comprises a 3' overhang of at least 1 nucleotide, e.g., at least one strand comprises a 3' overhang of at least 2 nucleotides.

In many embodiments, the dsRNA agent further comprises a ligand. The ligand can be conjugated to the 3' end of the sense strand of the dsRNA agent. The ligand can be an N-acetylgalactosamine (GalNAc) derivative including, but not limited to

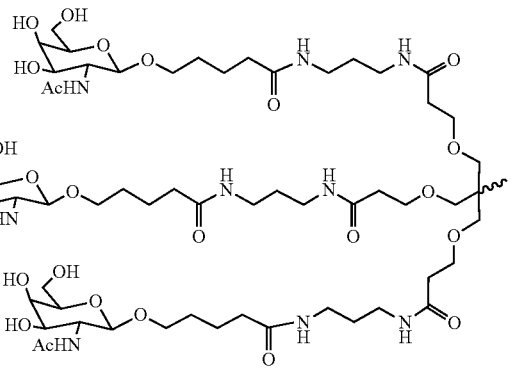

In various embodiments, the ligand is attached to the 5' end of the sense strand of the dsRNA agent, the 3' end of the antisense strand of the dsRNA agent, or the 5' end of the antisense strand of the dsRNA agent.

In some embodiments, the dsRNA agents of the invention comprise a plurality, e.g., 2, 3, 4, 5, or 6, of GalNAc, each independently attached to a plurality of nucleotides of the dsRNA agent through a plurality of monovalent linkers.

An exemplary dsRNA agent conjugated to the ligand as shown in the following schematic:

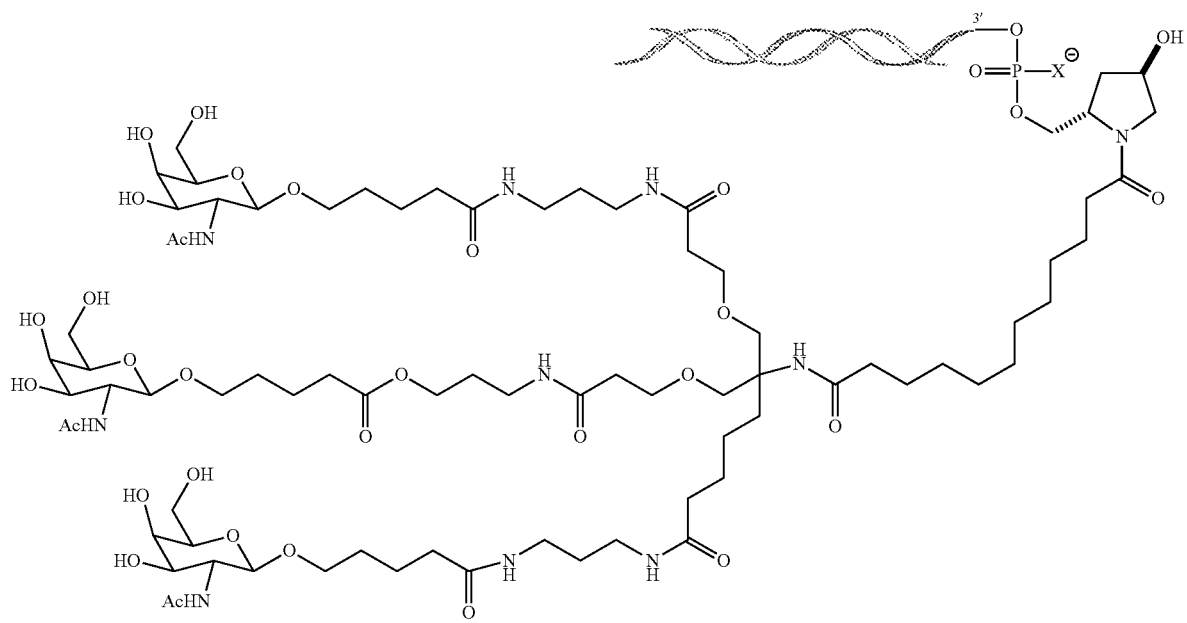

and, wherein X is O or S. In one embodiment, the X is O.

In certain embodiments, the ligand is a cholesterol.

In certain embodiments, the region of complementarity comprises any one of the antisense sequences in any one of Tables 3, 4, 6 and 7. In another embodiment, the region of complementarity consists of any one of the antisense sequences in any one of Tables 3, 4, 6 and 7.

In one embodiment, the dsRNA agent is selected from the group of dsRNA agents listed in any one of Tables 3, 4, 6, and 7.

In an aspect, the invention provides a double stranded ribonucleic acid (dsRNA) agents for inhibiting expression of a XDH gene, wherein the dsRNA agent comprises a sense strand and an antisense strand forming a double stranded region, wherein the sense strand comprises at least 15 contiguous nucleotides differing by no more than 3 nucleotides from the nucleotide sequence of SEQ ID NO:1 or 9 and the antisense strand comprises at least 15 contiguous nucleotides differing by no more than 3 nucleotides from the nucleotide sequence of SEQ ID NO:2 or 10, respectively, wherein substantially all of the nucleotides of the sense strand comprise a nucleotide modification selected from a 2'-O-methyl modification and a 2'-fluoro modification, wherein the sense strand comprises two phosphorothioate internucleotide linkages at the 5'-terminus, wherein substantially all of the nucleotides of the antisense strand comprise a nucleotide modification selected from a 2'-O-methyl modification and a 2'-fluoro modification, wherein the antisense strand comprises two phosphorothioate internucleotide linkages at the 5'-terminus and two phosphorothioate internucleotide linkages at the 3'-terminus, and wherein the sense strand is conjugated to one or more GalNAc derivatives attached through a branched bivalent or trivalent linker at the 3'-terminus.

In certain embodiments, all of the nucleotides of the sense strand and all of the nucleotides of the antisense strand are modified nucleotides. In certain embodiments, each strand has 19-30 nucleotides.

In certain embodiments, substantially all of the nucleotides of the sense strand are modified. In certain embodiments, substantially all of the nucleotides of the antisense strand are modified. In certain embodiments, substantially all of the nucleotides of both the sense strand and the antisense strand are modified.

In an aspect, the invention provides a cell containing the dsRNA agent as described herein.

In an aspect, the invention provides a vector encoding at least one strand of a dsRNA agent, wherein the dsRNA agent comprises a region of complementarity to at least a part of an mRNA encoding XDH, wherein the dsRNA agent is 30 base pairs or less in length, and wherein the dsRNA agent targets the mRNA for cleavage. In certain embodiments, the region of complementarity is at least 15 nucleotides in length. In certain embodiments, the region of complementarity is 19 to 23 nucleotides in length.

In an aspect, the invention provides a cell comprising a vector as described herein.

In an aspect, the invention provides a pharmaceutical composition for inhibiting expression of an XDH gene comprising the dsRNA agent of the invention. In one embodiment, the dsRNA agent is administered in an unbuffered solution. In certain embodiments, the unbuffered solution is saline or water. In other embodiments, the dsRNA agent is administered with a buffer solution. In such embodiments, the buffer solution can comprises acetate, citrate, prolamine, carbonate, or phosphate, or any combination thereof. For example, the buffer solution can be phosphate buffered saline (PBS).

In an aspect, the invention provides a pharmaceutical composition comprising the dsRNA agent of the invention and a lipid formulation. In certain embodiments, the lipid formulation comprises a LNP. In certain embodiments, the lipid formulation comprises a MC3.

In an aspect, the invention provides a method of inhibiting XDH expression in a cell, the method comprising (a) contacting the cell with the dsRNA agent of the invention or the pharmaceutical composition of the invention; and (b) maintaining the cell produced in step (a) for a time sufficient to obtain degradation of the mRNA transcript of an XDH gene, thereby inhibiting expression of the XDH gene in the cell. In certain embodiments, the cell is within a subject, for example, a human subject, for example a female human or a male human. In preferred embodiments, XDH expression is inhibited by at least 10%, 15%, 20%, preferably at least 30%, 40%, 50%, 60%, 70%, 80%, 90%, 95%, or to below the threshold of detection.

In an aspect, the invention provides a method of treating a subject having a disease or disorder that would benefit from reduction in XDH expression, the method comprising administering to the subject a therapeutically effective amount of the dsRNA agent of the invention or the pharmaceutical composition of the invention, thereby treating the subject.

In an aspect, the invention provides a method of preventing at least one symptom in a subject having a disease or disorder that would benefit from reduction in XDH expression, the method comprising administering to the subject a prophylactically effective amount of the dsRNA agent of the invention or a pharmaceutical composition of the invention, thereby preventing at least one symptom in the subject having a disorder that would benefit from reduction in XDH expression.

In certain embodiments, the administration of the dsRNA agent to the subject causes a decrease in the uric acid production. In certain embodiments, the administration of the dsRNA agent causes a decrease in the level of XDH in the subject, e.g., the level of XO or XDH protein, or XDH mRNA in the subject.

In certain embodiments, the XDH-associated disease is gout. In certain embodiments, the XDH-associated disease is Lesch Nyhan syndrome. In another embodiment, the XDH-associated disease is glycogen storage disease (GSD), e.g., GSD type Ia.

In certain embodiments, the invention further comprises administering an agent to decrease uric acid level in a subject, e.g., an inhibitor of uric acid production or an agent that increases uric acid elimination, to the subject with an XDH-associated disease. Agents to decrease the uric acid level in a subject include, but are not limited to, allopurinol, febuxostat, or an interleukin-1β (IL-1β) antagonist (canakinumab or rilonacept).

In certain embodiments, treatment of the subject with allopurinol is contraindicated. For example, administration of allopurinol is contraindicated in a subject with compromised renal function, due to, for example, chronic kidney disease, hypothyroidism, hyperinsulinemia, or insulin resistance. Administration of allopurinol may be contraindicated in combination with other drugs including, but not limited to, oral coagulants and probencid; subjects taking diuretics especially thiazide diuretics or other drugs that can reduce kidney function/have potential kidney toxicity.

In certain embodiments, the dsRNA agent is administered to a subject with an XDH-associated disease wherein the subject has compromised renal function. In certain embodiments, the dsRNA agent is administered to a subject with an XDH-associated disease wherein the subject is predisposed to compromised renal function, e.g., in a subject with hypertension, metabolic disorder, Type 1 diabetes, Type 2 diabetes, or the eldery. In certain embodiments, a subject is predisposed to compromised renal function as a result of treatment with one or more other therapeutic agents, e.g., diuretics.

In certain embodiments, the dsRNA agent is administered to a subject with an XDH-associated disease wherein the subject has failed treatment with allopurinol, e.g., gout flares during treatment, hypersensitivity reaction at any time after initiation of treatment with allopurinol or other unacceptable side effects as judged by the physician or patient.

Gout is often present in subjects who suffer from one or more co-morbidities. In certain embodiments, the dsRNA agent is administered to a subject with gout who has one or more of these co-morbidities. For example, in certain embodiments, the co-morbidity is reduced cardiac function or has cardiovascular disease. In certain embodiments, the co-morbidity is non-alcoholic fatty liver disease (NAFLD) or non-alcoholic steatohepatitis (NASH). In certain embodiments, the co-morbidity is metabolic syndrome. In certain embodiments, the co-morbidity is hyperlipidemia. In certain embodiments, the co-morbidity is reduced renal function (e.g., glomerular filtration rate of less than 60).

In certain embodiments if the invention, the dsRNA agent is administered to a subject with gout who is not obese.

In various embodiments, the dsRNA agent is administered at a dose of about 0.01 mg/kg to about 10 mg/kg or about 0.5 mg/kg to about 50 mg/kg. In some embodiments, the dsRNA agent is administered at a dose of about 10 mg/kg to about 30 mg/kg. In certain embodiments, the dsRNA agent is administered at a dose selected from 0.5 mg/kg, 1 mg/kg, 1.5 mg/kg, 3 mg/kg, 5 mg/kg, 10 mg/kg, and 30 mg/kg. In certain embodiments, the dsRNA agent is administered about once per week, once per month, once every other two months, or once a quarter (i.e., once every three months) at a dose of about 0.1 mg/kg to about 5.0 mg/kg.

In certain embodiments, the dsRNA agent is administered to the subject once a week. In certain embodiments, the dsdsRNA agent is administered to the subject once a month. In certain embodiments, the dsRNA agent is administered once per quarter (i.e., every three months).

In some embodiment, the dsdsRNA agent is administered to the subject subcutaneously.

In various embodiments, the methods of the invention further comprise monitoring the subject for at least one sign or symptom of an XDH-related disease, for example, gout.

BRIEF DESCRIPTION OF THE DRAWINGS

FIG. 1 is a schematic showing the uric acid metabolic pathway. XDH is labeled as XO in the schematic.

DETAILED DESCRIPTION OF THE INVENTION

The present invention provides iRNA compositions which effect the RNA-induced silencing complex (RISC)-mediated cleavage of RNA transcripts of a xanthine dehydrogenase (XDH) gene. The gene may be within a cell, e.g., a cell within a subject, such as a human. The use of these iRNAs enables the targeted degradation of mRNAs of the corresponding gene (XDH gene) in mammals.

The iRNAs of the invention have been designed to target the human XDH gene, including portions of the gene that are conserved in the XDH othologs of other mammalian species. Without intending to be limited by theory, it is believed that the specific target sites or the specific modifications in these iRNAs confer to the iRNAs of the invention improved efficacy, stability, potency, durability, and safety.

Accordingly, the present invention also provides methods for treating a subject having a disorder that would benefit from inhibiting or reducing the expression of an XDH gene, e.g., an XDH-associated disease, such as gout, using iRNA compositions which effect the RNA-induced silencing complex (RISC)-mediated cleavage of RNA transcripts of an XDH gene.

The iRNAs of the invention include an RNA strand (the antisense strand) having a region which is about 30 nucleotides or less in length, e.g., 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length, which region is substantially complementary to at least part of an mRNA transcript of an XDH gene. In certain embodiments, the iRNAs of the invention include an RNA strand (the antisense strand) which can include longer lengths, for example up to 66 nucleotides, e.g., 36-66, 26-36, 25-36, 31-60, 22-43, 27-53 nucleotides in length with a region of at least 19 contiguous nucleotides that is substantially complementary to at least a part of an mRNA transcript of an XDH gene. These iRNAs with the longer length antisense strands preferably include a second RNA strand (the sense strand) of 20-60 nucleotides in length wherein the sense and antisense strands form a duplex of 18-30 contiguous nucleotides.

The use of the iRNA agents described herein enable the targeted degradation of mRNAs of the corresponding gene (XDH gene) in mammals. Very low dosages of the iRNAs of the invention, in particular, can specifically and efficiently mediate RNA interference (RNAi), resulting in significant inhibition of expression of the corresponding gene (XDH gene). Using in vitro and in vivo assays, the present inventors have demonstrated that iRNAs targeting an XDH gene can mediate RNAi, resulting in significant inhibition of expression of XDH and a decrease in uric acid levels. Thus, methods and compositions including these iRNAs are useful for treating a subject having an XDH-associated disease, such as gout.

The following detailed description discloses how to make and use compositions containing iRNAs to inhibit the expression of an XDH gene as well as compositions, uses, and methods for treating subjects having diseases and disorders that would benefit from reduction of the expression of an XDH gene.

I. Definitions

In order that the present invention may be more readily understood, certain terms are first defined. In addition, it should be noted that whenever a value or range of values of a parameter are recited, it is intended that values and ranges intermediate to the recited values are also intended to be part of this invention.

The articles "a" and "an" are used herein to refer to one or to more than one (i.e., to at least one) of the grammatical object of the article. By way of example, "an element" means one element or more than one element, e.g., a plurality of elements.

The term "including" is used herein to mean, and is used interchangeably with, the phrase "including but not limited to".

The term "or" is used herein to mean, and is used interchangeably with, the term "and/or," unless context clearly indicates otherwise. For example, "sense strand or antisense strand" is understood as "sense strand or antisense strand or sense strand and antisense strand."

The term "about" is used herein to mean within the typical ranges of tolerances in the art. For example, "about" can be understood as about 2 standard deviations from the mean. In certain embodiments, about means±10%. In certain embodiments, about means±5%. When about is present before a series of numbers or a range, it is understood that "about" can modify each of the numbers in the series or range.

The term "at least" prior to a number or series of numbers is understood to include the number adjacent to the term "at least", and all subsequent numbers or integers that could logically be included, as clear from context. For example, the number of nucleotides in a nucleic acid molecule must be an integer. For example, "at least 18 nucleotides of a 21 nucleotide nucleic acid molecule" means that 18, 19, 20, or 21 nucleotides have the indicated property. When at least is present before a series of numbers or a range, it is understood that "at least" can modify each of the numbers in the series or range.

As used herein, "no more than" or "less than" is understood as the value adjacent to the phrase and logical lower values or intergers, as logical from context, to zero. For example, a duplex with an overhang of "no more than 2 nucleotides" has a 2, 1, or 0 nucleotide overhang. When "no more than" is present before a series of numbers or a range, it is understood that "no more than" can modify each of the numbers in the series or range.

As used herein, ranges include both the upper and lower limit.

In the event of a conflict between a sequence and its indicated site on a transcript or other sequence, the nucleotide sequence recited in the specification takes precedence.

Various embodiments of the invention can be combined as determined appropriate by one of skill in the art.

"Xanthine dehydrogenase" or "XDH" belongs to the group of molybdenum-containing hydroxylases involved in the oxidative metabolism of purines. The encoded protein has been identified as a moonlighting protein based on its ability to perform mechanistically distinct functions. Xanthine dehydrogenase can be converted to xanthine oxidase by reversible sulfhydryl oxidation or by irreversible proteolytic modification. As used herein, unless clear from context, xanthine dehydrogenase or XDH is understood to include both the xanthine dehydrogenase and xanthine oxidase ("XO" or "XOR") form of the protein. The protein is expressed predominantly in the intestine and the liver, but is also expressed in adipose tissue. Two transcript variants have been identified for the human isoform of the gene. Further information on XDH is provided, for example in the NCBI Gene database at www.ncbi.nlm.nih.gov/gene/7498 (which is incorporated herein by reference as of the date of filing this application). The amino acid and complete coding sequences of the reference sequence of the human XDH gene may be found in, for example, GenBank Accession No. GI: 91823270 (RefSeq Accession No. NM_000379.3; SEQ ID NO:1; the reverse complement of SEQ ID NO:1 is shown in SEQ ID NO:2) and GenBank Accession No. GI: 767915203 (RefSeq Accession No. XM_011533096; SEQ ID NO: 9; the reverse complement of SEQ ID NO:9 is shown in SEQ ID NO:10). The nucleotide and amino acid sequence of mammalian orthologs of the human XDH gene may be found in, for example, GI: 575501724 (RefSeq Accession No. NM_011723.3, mouse; SEQ ID NO:3; the reverse complement of SEQ ID NO:3 is shown in SEQ ID NO:4); GI: 8394543 (RefSeq Accession No. NM_017154.1, rat; SEQ ID NO:5; the reverse complement of SEQ ID NO:5 is shown in SEQ ID NO:6); GenBank Accession Nos. GI: 544482046 (RefSeq Accession Nos. XM_005576183.1 and XM_005576184.1, cynomolgus monkey; SEQ ID NO:7; the reverse complement of SEQ ID NO:7 is shown in SEQ ID NO:8, and SEQ ID NO:15; the reverse complement of SEQ ID NO:15 is shown in SEQ ID NO:16, respectively).

A number of naturally occurring SNPs in the XDH gene are known and can be found, for example, in the SNP database at the NCBI at http://www.ncbi.nlm.nih.gov/snp?LinkName=gene_snp&from_uid=7498 (which is incorporated herein by reference as of the date of filing this application) which lists over 3000 SNPs in human XDH. In preferred embodiments, such naturally occurring variants are included within the scope of the XDH gene sequence.

Additional examples of XDH mRNA sequences are readily available using publicly available databases, e.g., GenBank, UniProt, and OMIM.

As used herein, "target sequence" refers to a contiguous portion of the nucleotide sequence of an mRNA molecule formed during the transcription of an XDH gene, including mRNA that is a product of RNA processing of a primary transcription product. The target portion of the sequence will be at least long enough to serve as a substrate for iRNA-directed cleavage at or near that portion of the nucleotide sequence of an mRNA molecule formed during the transcription of an XDH gene. In one embodiment, the target sequence is within the protein coding region of XDH.

The target sequence may be from about 9-36 nucleotides in length, e.g., about 15-30 nucleotides in length. For example, the target sequence can be from about 15-30 nucleotides, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

As used herein, the term "strand comprising a sequence" refers to an oligonucleotide comprising a chain of nucleotides that is described by the sequence referred to using the standard nucleotide nomenclature.

"G," "C," "A," "T," and "U" each generally stand for a nucleotide that contains guanine, cytosine, adenine, thymidine, and uracil as a base, respectively. However, it will be understood that the term "ribonucleotide" or "nucleotide" can also refer to a modified nucleotide, as further detailed below, or a surrogate replacement moiety (see, e.g., Table 2). The skilled person is well aware that guanine, cytosine, adenine, and uracil can be replaced by other moieties without substantially altering the base pairing properties of an oligonucleotide comprising a nucleotide bearing such replacement moiety. For example, without limitation, a nucleotide comprising inosine as its base can base pair with nucleotides containing adenine, cytosine, or uracil. Hence, nucleotides containing uracil, guanine, or adenine can be replaced in the nucleotide sequences of dsRNA featured in the invention by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods featured in the invention.

The terms "iRNA," "RNAi agent," "iRNA agent," "RNA interference agent" as used interchangeably herein, refer to an agent that contains RNA as that term is defined herein, and which mediates the targeted cleavage of an RNA transcript via an RNA-induced silencing complex (RISC) pathway. iRNA directs the sequence-specific degradation of mRNA through a process known as RNA interference (RNAi). The iRNA modulates, e.g., inhibits, the expression of an XDH gene in a cell, e.g., a cell within a subject, such as a mammalian subject.

In one embodiment, an RNAi agent of the invention includes a single stranded RNAi that interacts with a target RNA sequence, e.g., an XDH target mRNA sequence, to direct the cleavage of the target RNA. Without wishing to be bound by theory it is believed that long double stranded RNA introduced into cells is broken down into double stranded short interfering RNAs (siRNAs) comprising a sense strand and an antisense strand by a Type III endonuclease known as Dicer (Sharp et al. (2001) *Genes Dev.* 15:485). Dicer, a ribonuclease-III-like enzyme, processes these dsRNA into 19-23 base pair short interfering RNAs with characteristic two base 3' overhangs (Bernstein, et al., (2001) *Nature* 409:363). These siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188). Thus, in one aspect the invention relates to a single stranded RNA (ssRNA) (the antisense strand of an siRNA duplex) generated within a cell and which promotes the formation of a RISC complex to effect silencing of the target gene, i.e., an XDH gene. Accordingly, the term "siRNA" is also used herein to refer to an RNAi as described above.

In another embodiment, the RNAi agent may be a single-stranded RNA that is introduced into a cell or organism to inhibit a target mRNA. Single-stranded RNAi agents bind to the RISC endonuclease, Argonaute 2, which then cleaves the target mRNA. The single-stranded siRNAs are generally 15-30 nucleotides in length and are chemically modified. The design and testing of single-stranded RNAs are described in U.S. Pat. No. 8,101,348 and in Lima et al., (2012) *Cell* 150:883-894, the entire contents of each of which are hereby incorporated herein by reference. Any of the antisense nucleotide sequences described herein may be used as a single-stranded siRNA as described herein or as chemically modified by the methods described in Lima et al., (2012) *Cell* 150:883-894.

In certain embodiments, an "iRNA" for use in the compositions, uses, and methods of the invention is a double stranded RNA and is referred to herein as a "double stranded RNAi agent," "double stranded RNA (dsRNA) molecule," "dsRNA agent," or "dsRNA". The term "dsRNA" refers to a complex of ribonucleic acid molecules, having a duplex structure comprising two anti-parallel and substantially complementary nucleic acid strands, referred to as having "sense" and "antisense" orientations with respect to a target RNA, i.e., an XDH gene. In some embodiments of the invention, a double stranded RNA (dsRNA) triggers the degradation of a target RNA, e.g., an mRNA, through a post-transcriptional gene-silencing mechanism referred to herein as RNA interference or RNAi.

In general, the majority of nucleotides of each strand of a dsRNA molecule are ribonucleotides, but as described in detail herein, each or both strands can also include one or more non-ribonucleotides, e.g., a deoxyribonucleotide or a modified nucleotide. In addition, as used in this specification, an "iRNA" may include ribonucleotides with chemical modifications; an iRNA may include substantial modifications at multiple nucleotides.

As used herein, the term "modified nucleotide" refers to a nucleotide having, independently, a modified sugar moiety, a modified internucleotide linkage, or modified nucleobase, or any combination thereof. Thus, the term modified nucleotide encompasses substitutions, additions or removal of, e.g., a functional group or atom, to internucleoside linkages, sugar moieties, or nucleobases. The modifications suitable for use in the agents of the invention include all types of modifications disclosed herein or known in the art. Any such modifications, as used in a siRNA type molecule, are encompassed by "iRNA" or "RNAi agent" for the purposes of this specification and claims.

The duplex region may be of any length that permits specific degradation of a desired target RNA through a RISC pathway, and may range from about 9 to 36 base pairs in length, e.g., about 15-30 base pairs in length, for example, about 9, 10, 11, 12, 13, 14, 15, 16, 17, 18, 19, 20, 21, 22, 23, 24, 25, 26, 27, 28, 29, 30, 31, 32, 33, 34, 35, or 36 base pairs in length, such as about 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

The two strands forming the duplex structure may be different portions of one larger RNA molecule, or they may be separate RNA molecules. Where the two strands are part of one larger molecule, and therefore are connected by an uninterrupted chain of nucleotides between the 3'-end of one strand and the 5'-end of the respective other strand forming the duplex structure, the connecting RNA chain is referred to as a "hairpin loop." A hairpin loop can comprise at least one unpaired nucleotide. In some embodiments, the hairpin loop can comprise at least 2, 3, 4, 5, 6, 7, 8, 9, 10, 20, 23 or more unpaired nucleotides. In some embodiments, the hairpin loop can be 10 or fewer nucleotides. In some embodiments, the hairpin loop can be 8 or fewer unpaired nucleotides. In some embodiments, the hairpin loop can be 4-10 unpaired nucleotides. In some embodiments, the hairpin loop can be 4-8 nucleotides.

Where the two substantially complementary strands of a dsRNA are comprised by separate RNA molecules, those molecules need not, but can be covalently connected. Where the two strands are connected covalently by means other than an uninterrupted chain of nucleotides between the 3'-end of one strand and the 5'-end of the respective other strand forming the duplex structure, the connecting structure is referred to as a "linker." The RNA strands may have the same or a different number of nucleotides. The maximum number of base pairs is the number of nucleotides in the shortest strand of the dsRNA minus any overhangs that are present in the duplex. In addition to the duplex structure, an RNAi may comprise one or more nucleotide overhangs.

In certain embodiments, an iRNA agent of the invention is a dsRNA, each strand of which comprises 19-23 nucleotides, that interacts with a target RNA sequence, e.g., an XDH gene. Without wishing to be bound by theory, long double stranded RNA introduced into cells is broken down into siRNA by a Type III endonuclease known as Dicer (Sharp et al. (2001) Genes Dev. 15:485). Dicer, a ribonuclease-III-like enzyme, processes the dsRNA into 19-23 base pair short interfering RNAs with characteristic two base 3' overhangs (Bernstein, et al., (2001) Nature 409:363). The siRNAs are then incorporated into an RNA-induced silencing complex (RISC) where one or more helicases unwind the siRNA duplex, enabling the complementary antisense strand to guide target recognition (Nykanen, et al., (2001) Cell 107:309). Upon binding to the appropriate target mRNA, one or more endonucleases within the RISC cleave the target to induce silencing (Elbashir, et al., (2001) Genes Dev. 15:188).

In some embodiments, an iRNA of the invention is a dsRNA of 24-30 nucleotides that interacts with a target RNA sequence, e.g., an XDH target mRNA sequence, to direct the cleavage of the target RNA. Without wishing to be bound by theory, long double stranded RNA introduced into cells is broken down into siRNA by a Type III endonuclease known as Dicer (Sharp et al. (2001) *Genes Dev.* 15:485). Dicer, a ribonuclease-III-like enzyme, processes the dsRNA into 19-23 base pair short interfering RNAs with characteristic two base 3' overhangs (Bernstein, et al., (2001) *Nature* 409:363). The siRNAs are then incorporated into an RNA-induced silencing complex (RISC) where one or more helicases unwind the siRNA duplex, enabling the complementary antisense strand to guide target recognition (Nykanen, et al., (2001) *Cell* 107:309). Upon binding to the appropriate target mRNA, one or more endonucleases within the RISC cleave the target to induce silencing (Elbashir, et al., (2001) *Genes Dev.* 15:188).

As used herein, the term "nucleotide overhang" refers to at least one unpaired nucleotide that protrudes from the duplex structure of a double strainded iRNA. For example, when a 3'-end of one strand of a dsRNA extends beyond the 5'-end of the other strand, or vice versa, there is a nucleotide overhang. A dsRNA can comprise an overhang of at least one nucleotide; alternatively the overhang can comprise at least two nucleotides, e.g., 2, 3, 4, 5, 6, 7, 9, 10, 11, 12, 13, 14, or 15 nucleotides. In certain embodiments, the overhang can be at least three nucleotides, at least four nucleotides, at least five nucleotides or more. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of either an antisense or sense strand of a dsRNA.

In certain embodiments, the antisense strand of a dsRNA has a 1-10 nucleotide, e.g., a 1-3, 1-4, 2-4, 1-5, 1, 2, 3, 4, 5, 6, 7, 8, 9, or 10 nucleotide, overhang at the 3'-end or the 5'-end. In certain embodiments, the overhang on the sense strand or the antisense strand, or both, can include extended lengths longer than 10 nucleotides, e.g., 1-30 nucleotides, 2-30 nucleotides, 10-30 nucleotides, or 10-15 nucleotides in length. In certain embodiments, an extended overhang is on the sense strand of the duplex. In certain embodiments, an extended overhang is present on the 3' end of the sense strand of the duplex. In certain embodiments, an extended overhang is present on the 5' end of the sense strand of the duplex. In certain embodiments, an extended overhang is on the antisense strand of the duplex. In certain embodiments, an extended overhang is present on the 3' end of the antisense strand of the duplex. In certain embodiments, an extended overhang is present on the 5' end of the antisense strand of the duplex. In certain embodiments, one or more of the nucleotides in the overhang is replaced with a nucleoside thiophosphate.

"Blunt" or "blunt end" means that there are no unpaired nucleotides at that end of the double stranded RNAi agent, i.e., no nucleotide overhang. A "blunt ended" double stranded RNAi agent is double stranded over its entire length, i.e., no nucleotide overhang at either end of the molecule. The RNAi agents of the invention include RNAi agents with no nucleotide overhang at one end (i.e., agents with one overhang and one blunt end) or with no nucleotide overhangs at either end.

The term "antisense strand" or "guide strand" refers to the strand of an iRNA, e.g., a dsRNA, which includes a region that is substantially complementary to a target sequence, e.g., an XDH mRNA. As used herein, the term "region of complementarity" refers to the region on the antisense strand that is substantially complementary to a sequence, for example a target sequence, e.g., an XDH nucleotide sequence, as defined herein. Where the region of complementarity is not fully complementary to the target sequence, the mismatches can be in the internal or terminal regions of the molecule. Generally, the most tolerated mismatches are in the terminal regions, e.g., within 5, 4, 3, 2, or 1 nucleotides of the 5'- or 3'-end of the iRNA. In some embodiments, a double stranded RNAi agent of the invention includes a nucleotide mismatch in the antisense strand. In some embodiments, a double stranded RNAi agent of the invention includes a nucleotide mismatch in the sense strand. In some embodiments, the nucleotide mismatch is, for example, within 5, 4, 3, 2, or 1 nucleotides from the 3'-end of the iRNA. In another embodiment, the nucleotide mismatch is, for example, in the 3'-terminal nucleotide of the iRNA.

The term "sense strand" or "passenger strand" as used herein, refers to the strand of an iRNA that includes a region that is substantially complementary to a region of the antisense strand as that term is defined herein.

As used herein, "substantially all of the nucleotides are modified" are largely but not wholly modified and can include not more than 5, 4, 3, 2, or 1 unmodified nucleotides.

As used herein, the term "cleavage region" refers to a region that is located immediately adjacent to the cleavage site. The cleavage site is the site on the target at which cleavage occurs. In some embodiments, the cleavage region comprises three bases on either end of, and immediately adjacent to, the cleavage site. In some embodiments, the cleavage region comprises two bases on either end of, and immediately adjacent to, the cleavage site. In some embodiments, the cleavage site specifically occurs at the site bound by nucleotides 10 and 11 of the antisense strand, and the cleavage region comprises nucleotides 11, 12 and 13.

As used herein, and unless otherwise indicated, the term "complementary," when used to describe a first nucleotide sequence in relation to a second nucleotide sequence, refers to the ability of an oligonucleotide or polynucleotide comprising the first nucleotide sequence to hybridize and form a duplex structure under certain conditions with an oligonucleotide or polynucleotide comprising the second nucleotide sequence, as will be understood by the skilled person. Such conditions can, for example, be stringent conditions, where stringent conditions can include: 400 mM NaCl, 40 mM PIPES pH 6.4, 1 mM EDTA, 50° C. or 70° C. for 12-16 hours followed by washing (see, e.g., "Molecular Cloning: A Laboratory Manual, Sambrook, et al. (1989) Cold Spring Harbor Laboratory Press). Other conditions, such as physiologically relevant conditions as can be encountered inside an organism, can apply. The skilled person will be able to determine the set of conditions most appropriate for a test of complementarity of two sequences in accordance with the ultimate application of the hybridized nucleotides.

Complementary sequences within an iRNA, e.g., within a dsRNA as described herein, include base-pairing of the oligonucleotide or polynucleotide comprising a first nucleotide sequence to an oligonucleotide or polynucleotide comprising a second nucleotide sequence over the entire length of one or both nucleotide sequences. Such sequences can be referred to as "fully complementary" with respect to each other herein. However, where a first sequence is referred to as "substantially complementary" with respect to a second sequence herein, the two sequences can be fully complementary, or they can form one or more, but generally not more than 5, 4, 3, or 2 mismatched base pairs upon hybridization for a duplex up to 30 base pairs, while retaining the ability to hybridize under the conditions most relevant to their ultimate application, e.g., inhibition of gene expression via a RISC pathway. However, where two oligonucleotides are designed to form, upon hybridization, one or more single stranded overhangs, such overhangs shall not be regarded as mismatches with regard to the determination of complementarity. For example, a dsRNA comprising one oligonucleotide 21 nucleotides in length and another oligonucleotide 23 nucleotides in length, wherein the longer oligonucleotide comprises a sequence of 21 nucleotides that is fully complementary to the shorter oligonucleotide, can yet be referred to as "fully complementary" for the purposes described herein.

"Complementary" sequences, as used herein, can also include, or be formed entirely from, non-Watson-Crick base pairs or base pairs formed from non-natural and modified nucleotides, in so far as the above requirements with respect to their ability to hybridize are fulfilled. Such non-Watson-Crick base pairs include, but are not limited to, G:U Wobble or Hoogstein base pairing.

The terms "complementary," "fully complementary," and "substantially complementary" herein can be used with respect to the base matching between the sense strand and the antisense strand of a dsRNA, or between the antisense strand of a double stranded RNAi agent and a target sequence, as will be understood from the context of their use.

As used herein, a polynucleotide that is "substantially complementary to at least part of" a messenger RNA (mRNA) refers to a polynucleotide that is substantially complementary to a contiguous portion of the mRNA of interest (e.g., an mRNA encoding an XDH gene). For example, a polynucleotide is complementary to at least a part of an XDH mRNA if the sequence is substantially complementary to a non-interrupted portion of an mRNA encoding an XDH gene.

Accordingly, in some embodiments, the antisense polynucleotides disclosed herein are fully complementary to the target XDH sequence. In some embodiments, the sense polynucleotides disclosed herein are fully complementary to the antisense sequence of a target XDH sequence.

In other embodiments, the antisense polynucleotides disclosed herein are substantially complementary to the target XDH sequence and comprise a contiguous nucleotide sequence which is at least about 80% complementary over its entire length to the equivalent region of the nucleotide sequence of SEQ ID NO:1 or 2, or a fragment of SEQ ID NO:1 or 2, such as about 85%, about 86%, about 87%, about 88%, about 89%, about 90%, about % 91%, about 92%, about 93%, about 94%, about 95%, about 96%, about 97%, about 98%, or about 99% complementary.

In other embodiments, the sense polynucleotides disclosed herein are substantially complementary to the antisense sequence of a target XDH sequence and comprise a contiguous nucleotide sequence which is at least about 80% complementary over its entire length to the equivalent region of the nucleotide sequence of SEQ ID NO:2, or a fragment of SEQ ID NO:2, such as about 85%, about 86%, about 87%, about 88%, about 89%, about 90%, about % 91%, about 92%, about 93%, about 94%, about 95%, about 96%, about 97%, about 98%, or about 99% complementary.

In one embodiment, an RNAi agent of the invention includes a sense strand that is substantially complementary to an antisense polynucleotide which, in turn, is complementary to a target XDH sequence and comprises a contiguous nucleotide sequence which is at least about 80% complementary over its entire length to any one of the sense strand nucleotide sequences in any one of Tables 3, 4, 6 and 7, or a fragment of any one of the sense strand nucleotide sequences in any one of Tables 3, 4, 6 and 7, such as about 85%, about 86%, about 87%, about 88%, about 89%, about 90%, about % 91%, about 92%, about 93%, about 94%, about 95%, about 96%, about 97%, about 98%, or about 99% complementary.

In some embodiments, an iRNA of the invention includes an antisense strand that is substantially complementary to the target XDH sequence and comprises a contiguous nucleotide sequence which is at least about 80% complementary over its entire length to the equivalent region of the nucleotide sequence of any one of the antisense strand nucleotide sequences in any one of Tables 3, 4, 6 and 7, or a fragment of any one of the antisense strand nucleotide sequences in any one of Tables 3, 4, 6 and 7, such as at least 85%, 90%, 95% complementary, or 100% complementary.

In an aspect of the invention, an agent for use in the methods and compositions of the invention is a single-stranded antisense oligonucleotide molecule that inhibits a target mRNA via an antisense inhibition mechanism. The single-stranded antisense oligonucleotide molecule is complementary to a sequence within the target mRNA. The single-stranded antisense oligonucleotides can inhibit translation in a stoichiometric manner by base pairing to the mRNA and physically obstructing the translation machinery, see Dias, N. et al., (2002) *Mol Cancer Ther* 1:347-355. The single-stranded antisense oligonucleotide molecule may be about 14 to about 30 nucleotides in length and have a sequence that is complementary to a target sequence. For example, the single-stranded antisense oligonucleotide molecule may comprise a sequence that is at least about 14, 15, 16, 17, 18, 19, 20, or more contiguous nucleotides from any one of the antisense sequences described herein.

The phrase "contacting a cell with an iRNA," such as a dsRNA, as used herein, includes contacting a cell by any possible means. Contacting a cell with an iRNA includes contacting a cell in vitro with the iRNA or contacting a cell in vivo with the iRNA. The contacting may be done directly or indirectly. Thus, for example, the iRNA may be put into physical contact with the cell by the individual performing the method, or alternatively, the iRNA may be put into a situation that will permit or cause it to subsequently come into contact with the cell.

Contacting a cell in vitro may be done, for example, by incubating the cell with the iRNA. Contacting a cell in vivo may be done, for example, by injecting the iRNA into or near the tissue where the cell is located, or by injecting the iRNA into another area, e.g., the bloodstream or the subcutaneous space, such that the agent will subsequently reach the tissue where the cell to be contacted is located. For example, the iRNA may contain or be coupled to a ligand, e.g., GalNAc3, that directs the iRNA to a site of interest, e.g., the liver. Combinations of in vitro and in vivo methods of contacting are also possible. For example, a cell may also be contacted in vitro with an iRNA and subsequently transplanted into a subject.

In certain embodiments, contacting a cell with an iRNA includes "introducing" or "delivering the iRNA into the cell" by facilitating or effecting uptake or absorption into the cell. Absorption or uptake of an iRNA can occur through unaided diffusion or active cellular processes, or by auxiliary agents or devices. Introducing an iRNA into a cell may be in vitro or in vivo. For example, for in vivo introduction, iRNA can be injected into a tissue site or administered systemically. In vivo delivery can also be done by a beta-glucan delivery system, such as those described in U.S. Pat. Nos. 5,032,401 and 5,607,677, and US Publication No. 2005/0281781, the entire contents of which are hereby incorporated herein by reference. In vitro introduction into a cell includes methods known in the art such as electroporation and lipofection. Further approaches are described herein below or are known in the art.

The term "lipid nanoparticle" or "LNP" is a vesicle comprising a lipid layer encapsulating a pharmaceutically active molecule, such as a nucleic acid molecule, e.g., an iRNA or a plasmid from which an iRNA is transcribed. LNPs are described in, for example, U.S. Pat. Nos. 6,858,225, 6,815,432, 8,158,601, and 8,058,069, the entire contents of which are hereby incorporated herein by reference.

As used herein, a "subject" is an animal, such as a mammal, including a primate (such as a human, a non-human primate, e.g., a monkey, and a chimpanzee), a non-primate (such as a cow, a pig, a camel, a llama, a horse, a goat, a rabbit, a sheep, a hamster, a guinea pig, a cat, a dog, a rat, a mouse, and a horse), or a bird (e.g., a duck or a goose) that expresses the target gene, either endogenously or heterologously. In certain embodiments, the subject is a human, such as a human being treated or assessed for a disease, disorder or condition that would benefit from reduction in XDH gene expression or replication; a human at risk for a disease, disorder or condition that would benefit from reduction in XDH gene expression; a human having a disease, disorder or condition that would benefit from reduction in XDH gene expression; or human being treated for a disease, disorder or condition that would benefit from reduction in XDH gene expression, as described herein. In some embodiments, the subject is a female human. In other embodiments, the subject is a male human.

As used herein, the terms "treating" or "treatment" refer to a beneficial or desired result including, but not limited to, alleviation or amelioration of one or more symptoms associated with XDH gene expression or XDH protein production, e.g., gout, NASH, or NAFLD. "Treatment" can also mean prolonging survival as compared to expected survival in the absence of treatment.

The term "lower" in the context of the level of XDH gene expression or XDH protein production in a subject, or a disease marker or symptom refers to a statistically significant decrease in such level. The decrease can be, for example, at least 20%, 25%, preferably at least 30%, 35%, 40%, 45%, 50%, 55%, 60%, 65%, 70%, 75%, 80%, 85%, 90%, or 95%, or below the level of detection for the detection method. In certain embodiments, the expression of the target is normalized, i.e., decreased to a level accepted as within the range of normal for an individual without such disorder. For example, chronic hyperuricemia is defined as serum urate levels greater than 6.8 mg/dl (greater than 360 mmol/), the level above which the physiological saturation threshold is exceeded (Mandell, Cleve. Clin. Med. 75:S5-S8, 2008). In certain embodiments, the reduction is the normalization of the level of a sign or symptom of a disease, a reduction in the difference between the subject level of a sign of the disease and the normal level of the sign for the disease (e.g., the upper level of normal when the level must be reduced to reach a normal level, and the lower level of normal when the level must be increased to reach a normal level). In certain embodiments, the methods include a clinically relevant inhibition of expression of XDH, e.g., as demonstrated by a clinically relevant outcome after treatment of a subject with an agent to reduce the expression of XDH.

As used herein, "prevention" or "preventing," when used in reference to a disease, disorder, or condition, that would benefit from a reduction in expression of an XDH gene or production of XDH protein, i.e., a disease, disorder, or condition that would benefit from reduction of a chronically elevated uric acid level, refers to a reduction in the likelihood that a subject will develop a symptom associated with such a disease, disorder, or condition, e.g., a symptom of XDH gene expression, such as the presence of chronic elevated serum levels of uric acid, e.g., hyperuricemia, gout, NASH, NAFLD, metabolic disorder, or cardiovascular disease. The failure to develop a disease, disorder or condition, or the reduction in the development of a symptom or comorbidity associated with such a disease, disorder or condition (e.g., by at least about 10% on a clinically accepted scale for that disease or disorder), the exhibition of delayed symptoms or disease progression by days, weeks, months or years, or the reduction or maintenance of a serum uric acid level at 6.8 mg/dl or less in a subject prone to elevated serum uric acid is considered effective prevention. Prevention may require the administration of more than one dose.

As used herein, the term "xanthine dehydrogenase-associated disease" or "XDH-associated disease," is a disease or disorder that is caused by, or associated with XDH gene expression or XDH protein production, e.g., a disease, disorder, or condition associated with chronic elevated levels of serum uric acid. The term "XDH-associated disease" includes a disease, disorder, or condition that would benefit from a decrease in XDH gene expression, replication, or protein activity. Non-limiting examples of XDH-associated diseases include, for example, hyperuricemia, gout, NAFLD, NASH, metabolic disorder, insulin resistance, cardiovascular disease, type 2 diabetes, and conditions linked to oxidative stress e.g., chronic low grade inflammation; or other XDH-associated disease.

In certain embodiments, an XDH-associated disease is gout. In certain embodiments, an XDH-associated disease is NASH or NAFLD.

As used herein, "chronic renal insufficiency" or "chronic kidney disease" is a condition characterized by a gradual loss of kidney function over time. Chronic kidney disease is commonly caused by high blood pressure or diabetes, but may result from other diseases or conditions such as lupus or may be caused by medications that have renal toxicity.

"Glomerulonephritis" includes a group of diseases that cause inflammation and damage to the kidney's filtering units. Inherited diseases, such as polycystic kidney disease, which causes large cysts to form in the kidneys and damage the surrounding tissue.

Congenital structural malformation of the kidneys, kidney stones or other obstructions (e.g., enlarged prostate) can result in chronic kidney disease.

Without being bound by mechanism, reduced kidney function can result in impaired renal clearance of uric acid. Kidney function is typically assessed by glomerular filtration rate (GFR) which is calculated based on blood creatinine level, age, body size, and gender. A lower GFR is indicative of lower kidney function. Kidney disease is typically diagnosed with a GFR of less than 60 for at least three months or a GFR of 60 or less with high protein in the urine is diagnostic of chronic kidney disease. However, a GFR of less than 90 is indicative of kidney damage with mild loss of kidney function.

"Therapeutically effective amount," as used herein, is intended to include the amount of an iRNA that, when administered to a patient for treating a subject having hyperuricemia, gout, NAFLD, NASH, metabolic disorder, insulin resistance, cardiovascular disease, type 2 diabetes, and conditions linked to oxidative stress, e.g., chronic low grade inflammation; or other XDH-associated disease, is sufficient to effect treatment of the disease (e.g., by diminishing, ameliorating or maintaining the existing disease or one or more symptoms of disease or its related comorbidities). The "therapeutically effective amount" may vary depending on the iRNA, how it is administered, the disease and its severity and the history, age, weight, family history, genetic makeup, stage of pathological processes mediated by XDH gene expression, the types of preceding or concomitant treatments, if any, and other individual characteristics of the patient to be treated. Treatment may require the administration of more than one dose.

As used herein, a therapeutically effective amount is sufficient to result in a clinically relevant lowering of chronic serum uric acid level in a subject and does not necessarily require the lowering of the chronic serum uric acid level to below 6.8 mg/dl. In certain embodiments, a therapeutically effective amount of an iRNA will lower the chronic uric acid of a subject to 6.8 mg/dl of uric acid or less, e.g., to 6 mg/dl or less, and optionally no lower than about 2 mg/dl. Studies of subjects with inherited disorders associated with profound, lifelong hypouricemia indicate that maintaining serum uric acid near or below 2 mg/dl is safe (Hershfeld, Curr. Opin. Rheumatol. 21:138-142, 2009).

"Prophylactically effective amount," as used herein, is intended to include the amount of an iRNA that, when administered to a subject who does not yet experience or display symptoms of hyperuricemia, gout, NAFLD, NASH, metabolic disorder, insulin resistance, cardiovascular disease, type 2 diabetes, and conditions linked to oxidative stress, e.g., chronic low grade inflammation; or other XDH-associated disease, but who may be predisposed to an XDH-associated disease, is sufficient to prevent or delay the development or progression of the disease or one or more symptoms of the disease for a clinically significant period of time, e.g., to lower a chronically elevated serum uric acid level, to prevent an increase in chronic serum uric acid level or to maintain a uric acid level below 6.8 mg/dl in a subject prone to elevated chronic serum uric acid level. The "prophylactically effective amount" may vary depending on the iRNA, how it is administered, the degree of risk of disease, and the history, age, weight, family history, genetic makeup, the types of preceding or concomitant treatments, if any, and other individual characteristics of the patient to be treated.

A "therapeutically-effective amount" or "prophylacticaly effective amount" also includes an amount of an iRNA that produces some desired local or systemic effect at a reasonable benefit/risk ratio applicable to any treatment. iRNAs employed in the methods of the present invention may be administered in a sufficient amount to produce a reasonable benefit/risk ratio applicable to such treatment. For example, in certain embodiments, treatment with the iRNAs of the invention will result in serum uric acid levels at 2-6.8 mg/dl, preferably 2-6 mg/dl in subjects. Maintenance of such uric acid levels will treat or prevent XDH-associated diseases.

The phrase "pharmaceutically acceptable" is employed herein to refer to those compounds, materials, compositions, or dosage forms which are, within the scope of sound medical judgment, suitable for use in contact with the tissues of human subjects and animal subjects without excessive toxicity, irritation, allergic response, or other problem or complication, commensurate with a reasonable benefit/risk ratio.

The phrase "pharmaceutically-acceptable carrier" as used herein means a pharmaceutically-acceptable material, composition, or vehicle, such as a liquid or solid filler, diluent, excipient, manufacturing aid (e.g., lubricant, talc magnesium, calcium or zinc stearate, or steric acid), or solvent encapsulating material, involved in carrying or transporting the subject compound from one organ, or portion of the body, to another organ, or portion of the body. Each carrier must be "acceptable" in the sense of being compatible with the other ingredients of the formulation and not injurious to the subject being treated. Some examples of materials which can serve as pharmaceutically-acceptable carriers include: (1) sugars, such as lactose, glucose and sucrose; (2) starches, such as corn starch and potato starch; (3) cellulose, and its derivatives, such as sodium carboxymethyl cellulose, ethyl cellulose and cellulose acetate; (4) powdered tragacanth; (5) malt; (6) gelatin; (7) lubricating agents, such as magnesium state, sodium lauryl sulfate and talc; (8) excipients, such as cocoa butter and suppository waxes; (9) oils, such as peanut oil, cottonseed oil, safflower oil, sesame oil, olive oil, corn oil and soybean oil; (10) glycols, such as propylene glycol; (11) polyols, such as glycerin, sorbitol, mannitol and polyethylene glycol; (12) esters, such as ethyl oleate and ethyl laurate; (13) agar; (14) buffering agents, such as magnesium hydroxide and aluminum hydroxide; (15) alginic acid; (16) pyrogen-free water; (17) isotonic saline; (18) Ringer's solution; (19) ethyl alcohol; (20) pH buffered solutions; (21) polyesters, polycarbonates or polyanhydrides; (22) bulking agents, such as polypeptides and amino acids (23) serum component, such as serum albumin, HDL and LDL; and (22) other non-toxic compatible substances employed in pharmaceutical formulations.

The term "sample," as used herein, includes a collection of similar fluids, cells, or tissues isolated from a subject, as well as fluids, cells, or tissues present within a subject. Examples of biological fluids include blood, serum and serosal fluids, plasma, cerebrospinal fluid, ocular fluids, lymph, urine, saliva, and the like. Tissue samples may include samples from tissues, organs, or localized regions. For example, samples may be derived from particular organs, parts of organs, or fluids or cells within those organs. In certain embodiments, samples may be derived from the liver (e.g., whole liver or certain segments of liver or certain types of cells in the liver, such as, e.g., hepatocytes). A "sample derived from a subject" can refer to blood drawn from the subject or plasma derived therefrom.

I. iRNAs of the Invention

The present invention provides iRNAs which inhibit the expression of an XDH gene. In preferred embodiments, the iRNA is a double stranded ribonucleic acid (dsRNA) molecule for inhibiting the expression of an XDH gene in a cell, such as a cell within a subject, e.g., a mammal, such as a human having an XDH-associated disease, e.g., hyperuricemia, gout. The dsRNA agent includes an antisense strand having a region of complementarity which is complementary to at least a part of an mRNA formed in the expression of an XDH gene. The region of complementarity is about 30 nucleotides or less in length (e.g., about 30, 29, 28, 27, 26, 25, 24, 23, 22, 21, 20, 19, or 18 nucleotides or less in length). Upon contact with a cell expressing the XDH gene, the iRNA inhibits the expression of the XDH gene (e.g., a human, a primate, a non-primate, or a bird XDH gene) by at least about 20% as assayed by, for example, a PCR or branched DNA (bDNA)-based method, or by a protein-based method, such as by immunofluorescence analysis, using, for example, western blotting or flow cytometric techniques. In preferred embodiments, inhibition of expression is determined by the qPCR method provided in the examples. For in vitro assessment of activity, percent inhibition is determined using the methods provided in Example 2 at a single dose at a 10 nM duplex final concentration. For in vivo studies, the level after treatment can be compared to, for example, an appropriate historical control or a pooled population sample control to determine the level of reduction, e.g., when a baseline value is not available for the subject.

A dsRNA agent includes two RNA strands that are complementary and hybridize to form a duplex structure under conditions in which the dsRNA will be used. One strand of a dsRNA (the antisense strand) includes a region of complementarity that is substantially complementary, and generally fully complementary, to a target sequence. The target sequence can be derived from the sequence of an mRNA formed during the expression of an XDH gene. The other strand (the sense strand) includes a region that is complementary to the antisense strand, such that the two strands hybridize and form a duplex structure when combined under suitable conditions. As described elsewhere herein and as known in the art, the complementary sequences of a dsRNA can also be contained as self-complementary regions of a single nucleic acid molecule, as opposed to being on separate oligonucleotides.

Generally, the duplex structure is 15 to 30 base pairs in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs in length. Ranges and lengths intermediate to the above recited ranges and lengths are also contemplated to be part of the invention.

Similarly, the region of complementarity to the target sequence may be 15 to 30 nucleotides in length, e.g., 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 nucleotides in length. Ranges and lengths intermediate to the above recited ranges and lengths are also contemplated to be part of the invention.

In some embodiments, the dsRNA is about 15 to 23 nucleotides in length, or about 25 to 30 nucleotides in length. In general, the dsRNA is long enough to serve as a substrate for the Dicer enzyme. For example, it is well-known in the art that dsRNAs longer than about 21-23 nucleotides in length may serve as substrates for Dicer. As the ordinarily skilled person will also recognize, the region of an RNA targeted for cleavage will most often be part of a larger RNA molecule, often an mRNA molecule. Where relevant, a "part" of an mRNA target is a contiguous sequence of an mRNA target of sufficient length to allow it to be a substrate for RNAi-directed cleavage (i.e., cleavage through a RISC pathway).

One of skill in the art will also recognize that the duplex region is a primary functional portion of a dsRNA, e.g., a duplex region of about 9 to about 36 base pairs, e.g., about 10-36, 11-36, 12-36, 13-36, 14-36, 15-36, 9-35, 10-35, 11-35, 12-35, 13-35, 14-35, 15-35, 9-34, 10-34, 11-34, 12-34, 13-34, 14-34, 15-34, 9-33, 10-33, 11-33, 12-33, 13-33, 14-33, 15-33, 9-32, 10-32, 11-32, 12-32, 13-32, 14-32, 15-32, 9-31, 10-31, 11-31, 12-31, 13-32, 14-31, 15-31, 15-30, 15-29, 15-28, 15-27, 15-26, 15-25, 15-24, 15-23, 15-22, 15-21, 15-20, 15-19, 15-18, 15-17, 18-30, 18-29, 18-28, 18-27, 18-26, 18-25, 18-24, 18-23, 18-22, 18-21, 18-20, 19-30, 19-29, 19-28, 19-27, 19-26, 19-25, 19-24, 19-23, 19-22, 19-21, 19-20, 20-30, 20-29, 20-28, 20-27, 20-26, 20-25, 20-24, 20-23, 20-22, 20-21, 21-30, 21-29, 21-28, 21-27, 21-26, 21-25, 21-24, 21-23, or 21-22 base pairs. Thus, in one embodiment, to the extent that it becomes processed to a functional duplex, of e.g., 15-30 base pairs, that targets a desired RNA for cleavage, an RNA molecule or complex of RNA molecules having a duplex region greater than 30 base pairs is a dsRNA. Thus, an ordinarily skilled artisan will recognize that in one embodiment, a miRNA is a dsRNA. In another embodiment, a dsRNA is not a naturally occurring miRNA. In another embodiment, an iRNA agent useful to target XDH gene expression is not generated in the target cell by cleavage of a larger dsRNA.

A dsRNA as described herein can further include one or more single-stranded nucleotide overhangs e.g., 1-4, 2-4, 1-3, 2-3, 1, 2, 3, or 4 nucleotides. dsRNAs having at least one nucleotide overhang can have superior inhibitory properties relative to their blunt-ended counterparts. A nucleotide overhang can comprise or consist of a nucleotide/nucleoside analog, including a deoxynucleotide/nucleoside. The overhang(s) can be on the sense strand, the antisense strand, or any combination thereof. Furthermore, the nucleotide(s) of an overhang can be present on the 5'-end, 3'-end, or both ends of an antisense or sense strand of a dsRNA.

A dsRNA can be synthesized by standard methods known in the art as further discussed below, e.g., by use of an automated DNA synthesizer, such as are commercially available from, for example, Biosearch, Applied Biosystems, Inc.

Double stranded RNAi compounds of the invention may be prepared using a two-step procedure. First, the individual strands of the double stranded RNA molecule are prepared separately. Then, the component strands are annealed. The individual strands of the siRNA compound can be prepared using solution-phase or solid-phase organic synthesis or both. Organic synthesis offers the advantage that the oligonucleotide strands comprising unnatural or modified nucleotides can be easily prepared. Similarly, single-stranded oligonucleotides of the invention can be prepared using solution-phase or solid-phase organic synthesis or both.

In an aspect, a dsRNA of the invention includes at least two nucleotide sequences, a sense sequence and an antisense sequence. The sense strand is selected from the group of sequences provided in any one of Tables 3, 4, 6 and 7, and the corresponding antisense strand of the sense strand is selected from the group of sequences of any one of Tables 3, 4, 6 and 7. In this aspect, one of the two sequences is complementary to the other of the two sequences, with one of the sequences being substantially complementary to a sequence of an mRNA generated in the expression of an XDH gene. As such, in this aspect, a dsRNA will include two oligonucleotides, where one oligonucleotide is described as the sense strand in any one of Tables 3, 4, 6 and 7, and the second oligonucleotide is described as the corresponding antisense strand of the sense strand in any one of Tables 3, 4, 6 and 7. In certain embodiments, the substantially complementary sequences of the dsRNA are contained on separate oligonucleotides. In other embodiments, the substantially complementary sequences of the dsRNA are contained on a single oligonucleotide.

It will be understood that, although some of the sequences in Tables 3, 4, 6 and 7 are described as modified and/or conjugated sequences, the RNA of the iRNA of the invention e.g., a dsRNA of the invention, may comprise any one of the sequences set forth in Tables 3, 4, 6 and 7 that is un-modified, un-conjugated, and/or modified and/or conjugated differently than described therein.

The skilled person is well aware that dsRNAs having a duplex structure of about 20 to 23 base pairs, e.g., 21, base pairs have been hailed as particularly effective in inducing RNA interference (Elbashir et al., *EMBO* 2001, 20:6877-6888). However, others have found that shorter or longer RNA duplex structures can also be effective (Chu and Rana (2007) *RNA* 14:1714-1719; Kim et al. (2005) *Nat Biotech* 23:222-226). In the embodiments described above, by virtue of the nature of the oligonucleotide sequences provided in any one of Tables 3, 4, 6 and 7, dsRNAs described herein can include at least one strand of a length of minimally 21 nucleotides. It can be reasonably expected that shorter duplexes having one of the sequences of Tables 3, 4, 6 and 7 minus only a few nucleotides on one or both ends can be similarly effective as compared to the dsRNAs described above. Hence, dsRNAs having a sequence of at least 15, 16, 17, 18, 19, 20, or more contiguous nucleotides derived from one of the sequences of Tables 3, 4, 6 and 7, and differing in their ability to inhibit the expression of an XDH gene by not more than about 5, 10, 15, 20, 25, or 30% inhibition from a dsRNA comprising the full sequence, are contemplated to be within the scope of the present invention.

In addition, the RNAs provided in Tables 3, 4, 6 and 7 identify a site(s) in an XDH transcript that is susceptible to RISC-mediated cleavage. As such, the present invention further features iRNAs that target within one of these sites. As used herein, an iRNA is said to target within a particular site of an RNA transcript if the iRNA promotes cleavage of the transcript anywhere within that particular site. Such an iRNA will generally include at least about 15 contiguous nucleotides from one of the sequences provided in Tables 3, 4, 6 and 7 coupled to additional nucleotide sequences taken from the region contiguous to the selected sequence in an XDH gene.

While a target sequence is generally about 15-30 nucleotides in length, there is wide variation in the suitability of particular sequences in this range for directing cleavage of any given target RNA. Various software packages and the guidelines set out herein provide guidance for the identification of optimal target sequences for any given gene target, but an empirical approach can also be taken in which a "window" or "mask" of a given size (as a non-limiting example, 21 nucleotides) is literally or figuratively (including, e.g., in silico) placed on the target RNA sequence to identify sequences in the size range that can serve as target sequences. By moving the sequence "window" progressively one nucleotide upstream or downstream of an initial target sequence location, the next potential target sequence can be identified, until the complete set of possible sequences is identified for any given target size selected. This process, coupled with systematic synthesis and testing of the identified sequences (using assays as described herein or as known in the art or provided herein) to identify those sequences that perform optimally can identify those RNA sequences that, when targeted with an iRNA agent, mediate the best inhibition of target gene expression. Thus, while the sequences identified, for example, in Tables 3, 4, 6 and 7 represent effective target sequences, it is contemplated that further optimization of inhibition efficiency can be achieved by progressively "walking the window" one nucleotide upstream or downstream of the given sequences to identify sequences with equal or better inhibition characteristics.

Further, it is contemplated that for any sequence identified, e.g., in Tables 3, 4, 6 and 7, further optimization could be achieved by systematically either adding or removing nucleotides to generate longer or shorter sequences and testing those sequences generated by walking a window of the longer or shorter size up or down the target RNA from that point. Again, coupling this approach to generating new candidate targets with testing for effectiveness of iRNAs based on those target sequences in an inhibition assay as known in the art or as described herein can lead to further improvements in the efficiency of inhibition. Further still, such optimized sequences can be adjusted by, e.g., the introduction of modified nucleotides as described herein or as known in the art, addition or changes in overhang, or other modifications as known in the art or discussed herein to further optimize the molecule (e.g., increasing serum stability or circulating half-life, increasing thermal stability, enhancing transmembrane delivery, targeting to a particular location or cell type, increasing interaction with silencing pathway enzymes, increasing release from endosomes) as an expression inhibitor.

An iRNA as described herein can contain one or more mismatches to the target sequence. In one embodiment, an iRNA as described herein contains no more than 3 mismatches. If the antisense strand of the iRNA contains mismatches to a target sequence, it is preferable that the area of mismatch is not located in the center of the region of complementarity. If the antisense strand of the iRNA contains mismatches to the target sequence, it is preferable that the mismatch be restricted to be within the last 5 nucleotides from either the 5'- or 3'-end of the region of complementarity. For example, for a 23 nucleotide iRNA agent the strand which is complementary to a region of an XDH gene, generally does not contain any mismatch within the central 13 nucleotides. The methods described herein or methods known in the art can be used to determine whether an iRNA containing a mismatch to a target sequence is effective in inhibiting the expression of an XDH gene. Consideration of the efficacy of iRNAs with mismatches in inhibiting expression of an XDH gene is important, especially if the particular region of complementarity in an XDH gene is known to have polymorphic sequence variation within the population.

II. Modified iRNAs of the Invention

In certain embodiments, the RNA of the iRNA of the invention e.g., a dsRNA, is un-modified, and does not comprise, e.g., chemical modifications or conjugations known in the art and described herein. In other embodiments, the RNA of an iRNA of the invention, e.g., a dsRNA, is chemically modified to enhance stability or other beneficial characteristics. In certain embodiments of the invention, substantially all of the nucleotides of an iRNA of the invention are modified. In other embodiments of the invention, all of the nucleotides of an iRNA or substantially all of the nucleotides of an iRNA are modified, i.e., not more than 5, 4, 3, 2, or 1 unmodified nucleotides are present in a strand of the iRNA.

The nucleic acids featured in the invention can be synthesized or modified by methods well established in the art, such as those described in "Current protocols in nucleic acid chemistry," Beaucage, S. L. et al. (Edrs.), John Wiley & Sons, Inc., New York, N.Y., USA, which is hereby incorporated herein by reference. Modifications include, for example, end modifications, e.g., 5'-end modifications (phosphorylation, conjugation, inverted linkages) or 3'-end modifications (conjugation, DNA nucleotides, inverted linkages, etc.); base modifications, e.g., replacement with stabilizing bases, destabilizing bases, or bases that base pair with an expanded repertoire of partners, removal of bases (abasic nucleotides), or conjugated bases; sugar modifications (e.g., at the 2'-position or 4'-position) or replacement of the sugar; or backbone modifications, including modification or replacement of the phosphodiester linkages. Specific examples of iRNA compounds useful in the embodiments described herein include, but are not limited to RNAs containing modified backbones or no natural internucleoside linkages. RNAs having modified backbones include, among others, those that do not have a phosphorus atom in the backbone. For the purposes of this specification, and as sometimes referenced in the art, modified RNAs that do not have a phosphorus atom in their internucleoside backbone can also be considered to be oligonucleosides. In some embodiments, a modified iRNA will have a phosphorus atom in its internucleoside backbone.

Modified RNA backbones include, for example, phosphorothioates, chiral phosphorothioates, phosphorodithioates, phosphotriesters, aminoalkylphosphotriesters, methyl and other alkyl phosphonates including 3'-alkylene phosphonates and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates having normal 3'-5' linkages, 2'-5'-linked analogs of these, and those having inverted polarity wherein the adjacent pairs of nucleoside units are linked 3'-5' to 5'-3' or 2'-5' to 5'-2'. Various salts, mixed salts and free acid forms are also included.

Representative US patents that teach the preparation of the above phosphorus-containing linkages include, but are not limited to, U.S. Pat. Nos. 3,687,808; 4,469,863; 4,476,301; 5,023,243; 5,177,195; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,316; 5,550,111; 5,563,253; 5,571,799; 5,587,361; 5,625,050; 6,028,188; 6,124,445; 6,160,109; 6,169,170; 6,172,209; 6,239,265; 6,277,603; 6,326,199; 6,346,614; 6,444,423; 6,531,590; 6,534,639; 6,608,035; 6,683,167; 6,858,715; 6,867,294; 6,878,805; 7,015,315; 7,041,816; 7,273,933; 7,321,029; and U.S. Pat. No. RE39464, the entire contents of each of which are hereby incorporated herein by reference.

Modified RNA backbones that do not include a phosphorus atom therein have backbones that are formed by short chain alkyl or cycloalkyl internucleoside linkages, mixed heteroatoms and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S, and $CH_2$ component parts.

Representative US patents that teach the preparation of the above oligonucleosides include, but are not limited to, U.S. Pat. Nos. 5,034,506; 5,166,315; 5,185,444; 5,214,134; 5,216,141; 5,235,033; 5,64,562; 5,264,564; 5,405,938; 5,434,257; 5,466,677; 5,470,967; 5,489,677; 5,541,307; 5,561,225; 5,596,086; 5,602,240; 5,608,046; 5,610,289; 5,618,704; 5,623,070; 5,663,312; 5,633,360; 5,677,437; and 5,677,439, the entire contents of each of which are hereby incorporated herein by reference.

Suitable RNA mimetics are contemplated for use in iRNAs provided herein, in which both the sugar and the internucleoside linkage, i.e., the backbone, of the nucleotide units are replaced with novel groups. The base units are maintained for hybridization with an appropriate nucleic acid target compound. One such oligomeric compound in which an RNA mimetic that has been shown to have excellent hybridization properties is referred to as a peptide nucleic acid (PNA). In PNA compounds, the sugar backbone of an RNA is replaced with an amide containing backbone, in particular an aminoethylglycine backbone. The nucleobases are retained and are bound directly or indirectly to aza nitrogen atoms of the amide portion of the backbone. Representative US patents that teach the preparation of PNA compounds include, but are not limited to, U.S. Pat. Nos. 5,539,082; 5,714,331; and 5,719,262, the entire contents of each of which are hereby incorporated herein by reference. Additional PNA compounds suitable for use in the iRNAs of the invention are described in, for example, in Nielsen et al., *Science*, 1991, 254, 1497-1500.

Some embodiments featured in the invention include RNAs with phosphorothioate backbones and oligonucleosides with heteroatom backbones, and in particular —$CH_2$—NH—$CH_2$—, —$CH_2$—N($CH_3$)—O—$CH_2$— [known as a methylene (methylimino) or MMI backbone], —$CH_2$—O—N($CH_3$)—$CH_2$—, —$CH_2$—N($CH_3$)—N($CH_3$)—$CH_2$— and —N($CH_3$)—$CH_2$—$CH_2$— [wherein the native phosphodiester backbone is represented as —O—P—O—$CH_2$— ] of the above-referenced U.S. Pat. No. 5,489,677, and the amide backbones of the above-referenced U.S. Pat. No. 5,602,240. In some embodiments, the RNAs featured herein have morpholino backbone structures of the above-referenced U.S. Pat. No. 5,034,506.

Modified RNAs can also contain one or more substituted sugar moieties. The iRNAs, e.g., dsRNAs, featured herein can include one of the following at the 2'-position: OH; F; O—, S—, or N-alkyl; O—, S—, or N-alkenyl; O—, S- or N-alkynyl; or O-alkyl-O-alkyl, wherein the alkyl, alkenyl and alkynyl can be substituted or unsubstituted $C_1$ to $C_{10}$ alkyl or $C_2$ to $C_{10}$ alkenyl and alkynyl. Exemplary suitable modifications include $O[(CH_2)_nO]_mCH_3$, $O(CH_2)_nOCH_3$, $O(CH_2)_nNH_2$, $O(CH_2)_nCH_3$, $O(CH_2)_nONH_2$, and $O(CH_2)_nON[(CH_2)_nCH_3)]_2$, where n and m are from 1 to about 10. In other embodiments, dsRNAs include one of the following at the 2' position: $C_1$ to $C_{10}$ lower alkyl, substituted lower alkyl, alkaryl, aralkyl, O-alkaryl or O-aralkyl, SH, $SCH_3$, OCN, Cl, Br, CN, $CF_3$, $OCF_3$, $SOCH_3$, $SO_2CH_3$, $ONO_2$, $NO_2$, $N_3$, $NH_2$, heterocycloalkyl, heterocycloalkaryl, aminoalkylamino, polyalkylamino, substituted silyl, an RNA cleaving group, a reporter group, an intercalator, a group for improving the pharmacokinetic properties of an iRNA, or a group for improving the pharmacodynamic properties of an iRNA, and other substituents having similar properties. In some embodiments, the modification includes a 2'-methoxyethoxy (2'-O—$CH_2CH_2OCH_3$, also known as 2'-O-(2-methoxyethyl) or 2'-MOE) (Martin et al., *Helv. Chim. Acta*, 1995, 78:486-504) i.e., an alkoxy-alkoxy group. Another exemplary modification is 2'-dimethylaminooxyethoxy, i.e., a $O(CH_2)_2ON(CH_3)_2$ group, also known as 2'-DMAOE, as described in examples herein below, and 2'-dimethylaminoethoxyethoxy (also known in the art as 2'-O-dimethylaminoethoxyethyl or 2'-DMAEOE), i.e., 2'-O—$CH_2$—O—$CH_2$—$N(CH_3)_2$. Further exemplary modifications include: 5'-Me-2'-F nucleotides, 5'-Me-2'-OMe nucleotides, 5'-Me-2'-deoxynucleotides, (both R and S isomers in these three families); 2'-alkoxyalkyl; and 2'-NMA (N-methylacetamide).

Other modifications include 2'-methoxy (2'-$OCH_3$), 2'-aminopropoxy (2'-$OCH_2CH_2CH_2NH_2$) and 2'-fluoro (2'-F) Similar modifications can also be made at other positions on the RNA of an iRNA, particularly the 3' position of the sugar on the 3' terminal nucleotide or in 2'-5' linked dsRNAs and the 5' position of 5' terminal nucleotide. iRNAs can also have sugar mimetics such as cyclobutyl moieties in place of the pentofuranosyl sugar. Representative US patents that teach the preparation of such modified sugar structures include, but are not limited to, U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, certain of which are commonly owned with the instant application. The entire contents of each of the foregoing are hereby incorporated herein by reference.

An iRNA can also include nucleobase (often referred to in the art simply as "base") modifications or substitutions. As used herein, "unmodified" or "natural" nucleobases include the purine bases adenine (A) and guanine (G), and the pyrimidine bases thymine (T), cytosine (C), and uracil (U). Modified nucleobases include other synthetic and natural nucleobases such as deoxy-thymine (dT), 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl anal other 8-substituted adenines and guanines, 5-halo, particularly 5-bromo, 5-trifluoromethyl and other 5-substituted uracils and cytosines, 7-methylguanine and 7-methyladenine, 8-azaguanine and 8-azaadenine, 7-deazaguanine and 7-daazaadenine and 3-deazaguanine and 3-deazaadenine. Further nucleobases include those disclosed in U.S. Pat. No. 3,687,808, those disclosed in Modified Nucleosides in Biochemistry, Biotechnology and Medicine, Herdewijn, P. ed. Wiley-VCH, 2008; those disclosed in The Concise Encyclopedia Of Polymer Science And Engineering, pages 858-859, Kroschwitz, J. I., ed. John Wiley & Sons, 1990, these disclosed by Englisch et al., Angewandte Chemie, International Edition, 1991, 30, 613, and those disclosed by Sanghvi, Y S., Chapter 15, dsRNA Research and Applications, pages 289-302, Crooke, S. T. and Lebleu, B., Ed., CRC Press, 1993. Certain of these nucleobases are particularly useful for increasing the binding affinity of the oligomeric compounds featured in the invention. These include 5-substituted pyrimidines, 6-azapyrimidines and N-2, N-6 and 0-6 substituted purines, including 2-aminopropyladenine, 5-propynyluracil and 5-propynylcytosine. 5-methylcytosine substitutions have been shown to increase nucleic acid duplex stability by 0.6-1.2° C. (Sanghvi, Y. S., Crooke, S. T. and Lebleu, B., Eds., dsRNA Research and Applications, CRC Press, Boca Raton, 1993, pp. 276-278) and are exemplary base substitutions, even more particularly when combined with 2'-O-methoxyethyl sugar modifications.

Representative US patents that teach the preparation of certain of the above noted modified nucleobases as well as other modified nucleobases include, but are not limited to, the above noted U.S. Pat. Nos. 3,687,808, 4,845,205; 5,130, 30; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; 5,681,941; 5,750,692; 6,015,886; 6,147,200; 6,166,197; 6,222,025; 6,235,887; 6,380,368; 6,528,640; 6,639,062; 6,617,438; 7,045,610; 7,427,672; and 7,495,088, the entire contents of each of which are hereby incorporated herein by reference.

The RNA of an iRNA can also be modified to include one or more locked nucleic acids (LNA). A locked nucleic acid is a nucleotide having a modified ribose moiety in which the ribose moiety comprises an extra bridge connecting the 2' and 4' carbons. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6(3): 833-843; Grunweller, A. et al., (2003) *Nucleic Acids Research* 31(12):3185-3193).

In some embodiments, the iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'—C4' have been removed (i.e. the covalent carbon-oxygen-carbon bond between the C1' and C4' carbons). In another example, the C2'—C3' bond (i.e. the covalent carbon-carbon bond between the C2' and C3' carbons) of the sugar has been removed (see *Nuc. Acids Symp. Series*, 52, 133-134 (2008) and Fluiter et al., *Mol. Biosyst.*, 2009, 10, 1039 hereby incorporated by reference).

The RNA of an iRNA can also be modified to include one or more bicyclic sugar moieties. A "bicyclic sugar" is a furanosyl ring modified by the bridging of two atoms. A "bicyclic nucleoside" ("BNA") is a nucleoside having a sugar moiety comprising a bridge connecting two carbon atoms of the sugar ring, thereby forming a bicyclic ring system. In certain embodiments, the bridge connects the 4'-carbon and the 2'-carbon of the sugar ring. Thus, in some embodiments an agent of the invention may include one or more locked nucleic acids (LNA). A locked nucleic acid is a nucleotide having a modified ribose moiety in which the ribose moiety comprises an extra bridge connecting the 2' and 4' carbons. In other words, an LNA is a nucleotide comprising a bicyclic sugar moiety comprising a 4'-CH$_2$—O-2' bridge. This structure effectively "locks" the ribose in the 3'-endo structural conformation. The addition of locked nucleic acids to siRNAs has been shown to increase siRNA stability in serum, and to reduce off-target effects (Elmen, J. et al., (2005) *Nucleic Acids Research* 33(1):439-447; Mook, O R. et al., (2007) *Mol Canc Ther* 6β): 833-843; Grunweller, A. et al., (2003) *Nucleic Acids Research* 31(12):3185-3193). Examples of bicyclic nucleosides for use in the polynucleotides of the invention include without limitation nucleosides comprising a bridge between the 4' and the 2' ribosyl ring atoms. In certain embodiments, the antisense polynucleotide agents of the invention include one or more bicyclic nucleosides comprising a 4' to 2' bridge. Examples of such 4' to 2' bridged bicyclic nucleosides, include but are not limited to 4'-(CH$_2$)—O-2' (LNA); 4'-(CH$_2$)—S-2; 4'—(CH$_2$)$_2$—O-2' (ENA); 4'-CH(CH$_3$)—O-2' (also referred to as "constrained ethyl" or "cEt") and 4'-CH(CH$_2$OCH$_3$)—O-2' (and analogs thereof; see, e.g., U.S. Pat. No. 7,399,845); 4'-C(CH$_3$)(CH$_3$)—O-2' (and analogs thereof; see e.g., U.S. Pat. No. 8,278,283); 4'-CH$_2$—N(OCH$_3$)-2' (and analogs thereof; see e.g., U.S. Pat. No. 8,278,425); 4'-CH$_2$—O—N(CH$_3$)-2' (see, e.g., US Patent Publication No. 2004/0171570); 4'-CH$_2$—N(R)—O-2', wherein R is H, C1-C12 alkyl, or a protecting group (see, e.g., U.S. Pat. No. 7,427,672); 4'-CH$_2$—C(H)(CH$_3$)-2' (see, e.g., Chattopadhyaya et al., *J. Org. Chem.*, 2009, 74, 118-134); and 4'-CH$_2$—C(=CH$_2$)-2' (and analogs thereof; see, e.g., U.S. Pat. No. 8,278,426). The entire contents of each of the foregoing are hereby incorporated herein by reference.

Additional representative US patents and US patent Publications that teach the preparation of locked nucleic acid nucleotides include, but are not limited to, the following: U.S. Pat. Nos. 6,268,490; 6,525,191; 6,670,461; 6,770,748; 6,794,499; 6,998,484; 7,053,207; 7,034,133; 7,084,125; 7,399,845; 7,427,672; 7,569,686; 7,741,457; 8,022,193; 8,030,467; 8,278,425; 8,278,426; 8,278,283; US 2008/0039618; and US 2009/0012281, the entire contents of each of which are hereby incorporated herein by reference.

Any of the foregoing bicyclic nucleosides can be prepared having one or more stereochemical sugar configurations including for example α-L-ribofuranose and β-D-ribofuranose (see WO 99/14226).

The RNA of an iRNA can also be modified to include one or more constrained ethyl nucleotides. As used herein, a "constrained ethyl nucleotide" or "cEt" is a locked nucleic acid comprising a bicyclic sugar moiety comprising a 4'-CH(CH$_3$)—O-2' bridge. In one embodiment, a constrained ethyl nucleotide is in the S conformation referred to herein as "S-cEt."

An iRNA of the invention may also include one or more "conformationally restricted nucleotides" ("CRN"). CRN are nucleotide analogs with a linker connecting the C2' and C4' carbons of ribose or the C3 and —C5' carbons of ribose. CRN lock the ribose ring into a stable conformation and increase the hybridization affinity to mRNA. The linker is of sufficient length to place the oxygen in an optimal position for stability and affinity resulting in less ribose ring puckering.

Representative publications that teach the preparation of certain of the above noted CRN include, but are not limited to, US Patent Publication No. 2013/0190383; and PCT publication WO 2013/036868, the entire contents of each of which are hereby incorporated herein by reference.

In some embodiments, the iRNA of the invention comprises one or more monomers that are UNA (unlocked nucleic acid) nucleotides. UNA is unlocked acyclic nucleic acid, wherein any of the bonds of the sugar has been removed, forming an unlocked "sugar" residue. In one example, UNA also encompasses monomer with bonds between C1'—C4' have been removed (i.e. the covalent carbon-oxygen-carbon bond between the C1' and C4' carbons). In another example, the C2'—C3' bond (i.e. the covalent carbon-carbon bond between the C2' and C3' carbons) of the sugar has been removed (see *Nuc. Acids Symp. Series*, 52, 133-134 (2008) and Fluiter et al., *Mol. Biosyst.*, 2009, 10, 1039 hereby incorporated by reference).

Representative US publications that teach the preparation of UNA include, but are not limited to, U.S. Pat. No. 8,314,227; and US Patent Publication Nos. 2013/0096289; 2013/0011922; and 2011/0313020, the entire contents of each of which are hereby incorporated herein by reference.

Potentially stabilizing modifications to the ends of RNA molecules can include N-(acetylaminocaproyl)-4-hydroxyprolinol (Hyp-C6-NHAc), N-(caproyl-4-hydroxyprolinol (Hyp-C6), N-(acetyl-4-hydroxyprolinol (Hyp-NHAc), thymidine-2'-0-deoxythymidine (ether), N-(aminocaproyl)-4-hydroxyprolinol (Hyp-C6-amino), 2-docosanoyl-uridine-3"-phosphate, inverted base dT(idT) and others. Disclosure of this modification can be found in PCT Publication No. WO 2011/005861.

Other modifications of the nucleotides of an iRNA of the invention include a 5' phosphate or 5' phosphate mimic, e.g., a 5'-terminal phosphate or phosphate mimic on the antisense strand of an iRNA. Suitable phosphate mimics are disclosed in, for example US Patent Publication No. 2012/0157511, the entire contents of which are incorporated herein by reference.

A. Modified iRNAs Comprising Motifs of the Invention

In certain aspects of the invention, the double stranded RNAi agents of the invention include agents with chemical modifications as disclosed, for example, in U.S. Patent Publication No. 2014/0315835 and PCT Publication No. WO 2013/075035, the entire contents of each of which are incorporated herein by reference. WO 2013/075035 and U.S. 2014/0315835 provide motifs of three identical modifications on three consecutive nucleotides into a sense strand or antisense strand of a dsRNAi agent, particularly at or near the cleavage site. In some embodiments, the sense strand and antisense strand of the dsRNAi agent may otherwise be completely modified. The introduction of these motifs interrupts the modification pattern, if present, of the sense or antisense strand. The dsRNAi agent may be optionally conjugated with a GalNAc derivative ligand, for instance on the sense strand.

More specifically, when the sense strand and antisense strand of the double stranded RNAi agent are completely modified to have one or more motifs of three identical modifications on three consecutive nucleotides at or near the cleavage site of at least one strand of a dsRNAi agent, the gene silencing activity of the dsRNAi agent was observed.

Accordingly, the invention provides double stranded RNAi agents capable of inhibiting the expression of a target gene (i.e., XDH gene) in vivo. The RNAi agent comprises a sense strand and an antisense strand. Each strand of the RNAi agent may be, independently, 12-30 nucleotides in length. For example, each strand may independently be 14-30 nucleotides in length, 17-30 nucleotides in length, 25-30 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length.

The sense strand and antisense strand typically form a duplex double stranded RNA ("dsRNA"), also referred to herein as "dsRNAi agent." The duplex region of a dsRNAi agent may be 12-30 nucleotide pairs in length. For example, the duplex region can be 14-30 nucleotide pairs in length, 17-30 nucleotide pairs in length, 27-30 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, 27, 28, 29, and 30 nucleotides in length.

In certain embodiments, the dsRNAi agent may contain one or more overhang regions or capping groups at the 3'-end, 5'-end, or both ends of one or both strands. The overhang can be, independently, 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. In certain embodiments, the overhang regions can include extended overhang regions as provided above. The overhangs can be the result of one strand being longer than the other, or the result of two strands of the same length being staggered. The overhang can form a mismatch with the target mRNA or it can be complementary to the gene sequences being targeted or can be another sequence. The first and second strands can also be joined, e.g., by additional bases to form a hairpin, or by other non-base linkers.

In certain embodiments, the nucleotides in the overhang region of the dsRNAi agent can each independently be a modified or unmodified nucleotide including, but no limited to 2'-sugar modified, such as, 2'-F, 2'-O-methyl, thymidine (T), 2'-O-methoxyethyl-5-methyluridine (Teo), 2'-O-methoxyethyladenosine (Aeo), 2'-O-methoxyethyl-5-methylcytidine (m5Ceo), and any combinations thereof. For example, TT can be an overhang sequence for either end on either strand. The overhang can form a mismatch with the target mRNA or it can be complementary to the gene sequences being targeted or can be another sequence.

The 5'- or 3'-overhangs at the sense strand, antisense strand, or both strands of the dsRNAi agent may be phosphorylated. In some embodiments, the overhang region(s) contains two nucleotides having a phosphorothioate between the two nucleotides, where the two nucleotides can be the same or different. In some embodiments, the overhang is present at the 3'-end of the sense strand, antisense strand, or both strands. In some embodiments, this 3'-overhang is present in the antisense strand. In some embodiments, this 3'-overhang is present in the sense strand.

The dsRNAi agent may contain only a single overhang, which can strengthen the interference activity of the RNAi, without affecting its overall stability. For example, the single-stranded overhang may be located at the 3'-end of the sense strand or, alternatively, at the 3'-end of the antisense strand. The RNAi may also have a blunt end, located at the 5'-end of the antisense strand (or the 3'-end of the sense strand) or vice versa. Generally, the antisense strand of the dsRNAi agent has a nucleotide overhang at the 3'-end, and the 5'-end is blunt. While not wishing to be bound by theory, the asymmetric blunt end at the 5'-end of the antisense strand and 3'-end overhang of the antisense strand favor the guide strand loading into RISC process.

In certain embodiments, the dsRNAi agent is a double ended bluntmer of 19 nucleotides in length, wherein the sense strand contains at least one motif of three 2'-F modifications on three consecutive nucleotides at positions 7, 8, 9 from the 5' end. The antisense strand contains at least one motif of three 2'-O-methyl modifications on three consecutive nucleotides at positions 11, 12, 13 from the 5' end.

In other embodiments, the dsRNAi agent is a double ended bluntmer of 20 nucleotides in length, wherein the sense strand contains at least one motif of three 2'-F modifications on three consecutive nucleotides at positions 8, 9, 10 from the 5' end. The antisense strand contains at least one motif of three 2'-O-methyl modifications on three consecutive nucleotides at positions 11, 12, 13 from the 5' end.

In yet other embodiments, the dsRNAi agent is a double ended bluntmer of 21 nucleotides in length, wherein the sense strand contains at least one motif of three 2'-F modifications on three consecutive nucleotides at positions 9, 10, 11 from the 5' end. The antisense strand contains at least one motif of three 2'-O-methyl modifications on three consecutive nucleotides at positions 11, 12, 13 from the 5' end.

In certain embodiments, the dsRNAi agent comprises a 21 nucleotide sense strand and a 23 nucleotide antisense strand, wherein the sense strand contains at least one motif of three 2'-F modifications on three consecutive nucleotides at positions 9, 10, 11 from the 5' end; the antisense strand contains at least one motif of three 2'-O-methyl modifications on three consecutive nucleotides at positions 11, 12, 13 from the 5' end, wherein one end of the RNAi agent is blunt, while the other end comprises a 2 nucleotide overhang. Preferably, the 2 nucleotide overhang is at the 3'-end of the antisense strand.

When the 2 nucleotide overhang is at the 3'-end of the antisense strand, there may be two phosphorothioate internucleotide linkages between the terminal three nucleotides, wherein two of the three nucleotides are the overhang nucleotides, and the third nucleotide is a paired nucleotide next to the overhang nucleotide. In one embodiment, the RNAi agent additionally has two phosphorothioate internucleotide linkages between the terminal three nucleotides at both the 5'-end of the sense strand and at the 5'-end of the antisense strand. In certain embodiments, every nucleotide in the sense strand and the antisense strand of the dsRNAi agent, including the nucleotides that are part of the motifs are modified nucleotides. In certain embodiments each residue is independently modified with a 2'-O-methyl or 3'-fluoro, e.g., in an alternating motif. Optionally, the dsRNAi agent further comprises a ligand (preferably GalNAc, e.g., GalNAc$_3$).

In certain embodiments, the dsRNAi agent comprises a sense and an antisense strand, wherein the sense strand is 25-30 nucleotide residues in length, wherein starting from the 5' terminal nucleotide (position 1) positions 1 to 23 of the first strand comprise at least 8 ribonucleotides; the antisense strand is 36-66 nucleotide residues in length and, starting from the 3' terminal nucleotide, comprises at least 8 ribonucleotides in the positions paired with positions 1-23 of sense strand to form a duplex; wherein at least the 3 ' terminal nucleotide of antisense strand is unpaired with sense strand, and up to 6 consecutive 3' terminal nucleotides are unpaired with sense strand, thereby forming a 3' single stranded overhang of 1-6 nucleotides; wherein the 5' terminus of antisense strand comprises from 10-30 consecutive nucleotides which are unpaired with sense strand, thereby forming a 10-30 nucleotide single stranded 5' overhang; wherein at least the sense strand 5' terminal and 3' terminal nucleotides are base paired with nucleotides of antisense strand when sense and antisense strands are aligned for maximum complementarity, thereby forming a substantially duplexed region between sense and antisense strands; and antisense strand is sufficiently complementary to a target RNA along at least 19 ribonucleotides of antisense strand length to reduce target gene expression when the double stranded nucleic acid is introduced into a mammalian cell; and wherein the sense strand contains at least one motif of three 2'-F modifications on three consecutive nucleotides, where at least one of the motifs occurs at or near the cleavage site. The antisense strand contains at least one motif of three 2'-O-methyl modifications on three consecutive nucleotides at or near the cleavage site.

In certain embodiments, the dsRNAi agent comprises sense and antisense strands, wherein the dsRNAi agent comprises a first strand having a length which is at least 25 and at most 29 nucleotides and a second strand having a length which is at most 30 nucleotides with at least one motif of three 2'-O-methyl modifications on three consecutive nucleotides at position 11, 12, 13 from the 5' end;

wherein the 3' end of the first strand and the 5' end of the second strand form a blunt end and the second strand is 1-4 nucleotides longer at its 3' end than the first strand, wherein the duplex region region which is at least 25 nucleotides in length, and the second strand is sufficiently complementary to a target mRNA along at least 19 nucleotide of the second strand length to reduce target gene expression when the RNAi agent is introduced into a mammalian cell, and wherein Dicer cleavage of the dsRNAi agent preferentially results in an siRNA comprising the 3'-end of the second strand, thereby reducing expression of the target gene in the mammal. Optionally, the dsRNAi agent further comprises a ligand.

In certain embodiments, the sense strand of the dsRNAi agent contains at least one motif of three identical modifications on three consecutive nucleotides, where one of the motifs occurs at the cleavage site in the sense strand.

In certain embodiments, the antisense strand of the dsR-NAi agent can also contain at least one motif of three identical modifications on three consecutive nucleotides, where one of the motifs occurs at or near the cleavage site in the antisense strand.

For a dsRNAi agent having a duplex region of 17-23 nucleotides in length, the cleavage site of the antisense strand is typically around the 10, 11, and 12 positions from the 5'-end. Thus the motifs of three identical modifications may occur at the 9, 10, 11 positions; the 10, 11, 12 positions; the 11, 12, 13 positions; the 12, 13, 14 positions; or the 13, 14, 15 positions of the antisense strand, the count starting from the first nucleotide from the 5'-end of the antisense strand, or, the count starting from the first paired nucleotide within the duplex region from the 5'-end of the antisense strand. The cleavage site in the antisense strand may also change according to the length of the duplex region of the dsRNAi agent from the 5'-end.

The sense strand of the dsRNAi agent may contain at least one motif of three identical modifications on three consecutive nucleotides at the cleavage site of the strand; and the antisense strand may have at least one motif of three identical modifications on three consecutive nucleotides at or near the cleavage site of the strand. When the sense strand and the antisense strand form a dsRNA duplex, the sense strand and the antisense strand can be so aligned that one motif of the three nucleotides on the sense strand and one motif of the three nucleotides on the antisense strand have at least one nucleotide overlap, i.e., at least one of the three nucleotides of the motif in the sense strand forms a base pair with at least one of the three nucleotides of the motif in the antisense strand. Alternatively, at least two nucleotides may overlap, or all three nucleotides may overlap.

In some embodiments, the sense strand of the dsRNAi agent may contain more than one motif of three identical modifications on three consecutive nucleotides. The first motif may occur at or near the cleavage site of the strand and the other motifs may be a wing modification. The term "wing modification" herein refers to a motif occurring at another portion of the strand that is separated from the motif at or near the cleavage site of the same strand. The wing modification is either adjacent to the first motif or is separated by at least one or more nucleotides. When the motifs are immediately adjacent to each other then the chemistries of the motifs are distinct from each other, and when the motifs are separated by one or more nucleotide than the chemistries can be the same or different. Two or more wing modifications may be present. For instance, when two wing modifications are present, each wing modification may occur at one end relative to the first motif which is at or near cleavage site or on either side of the lead motif.

Like the sense strand, the antisense strand of the dsRNAi agent may contain more than one motif of three identical modifications on three consecutive nucleotides, with at least one of the motifs occurring at or near the cleavage site of the strand. This antisense strand may also contain one or more wing modifications in an alignment similar to the wing modifications that may be present on the sense strand.

In some embodiments, the wing modification on the sense strand or antisense strand of the dsRNAi agent typically does not include the first one or two terminal nucleotides at the 3'-end, 5'-end, or both ends of the strand.

In other embodiments, the wing modification on the sense strand or antisense strand of the dsRNAi agent typically does not include the first one or two paired nucleotides within the duplex region at the 3'-end, 5'-end, or both ends of the strand.

When the sense strand and the antisense strand of the dsRNAi agent each contain at least one wing modification, the wing modifications may fall on the same end of the duplex region, and have an overlap of one, two, or three nucleotides.

When the sense strand and the antisense strand of the dsRNAi agent each contain at least two wing modifications, the sense strand and the antisense strand can be so aligned that two modifications each from one strand fall on one end of the duplex region, having an overlap of one, two, or three nucleotides; two modifications each from one strand fall on the other end of the duplex region, having an overlap of one, two or three nucleotides; two modifications one strand fall on each side of the lead motif, having an overlap of one, two, or three nucleotides in the duplex region.

In some embodiments, every nucleotide in the sense strand and antisense strand of the dsRNAi agent, including the nucleotides that are part of the motifs, may be modified. Each nucleotide may be modified with the same or different modification which can include one or more alteration of one or both of the non-linking phosphate oxygens or of one or more of the linking phosphate oxygens; alteration of a constituent of the ribose sugar, e.g., of the 2'-hydroxyl on the ribose sugar; wholesale replacement of the phosphate moiety with "dephospho" linkers; modification or replacement of a naturally occurring base; and replacement or modification of the ribose-phosphate backbone.

As nucleic acids are polymers of subunits, many of the modifications occur at a position which is repeated within a nucleic acid, e.g., a modification of a base, or a phosphate moiety, or a non-linking O of a phosphate moiety. In some cases the modification will occur at all of the subject positions in the nucleic acid but in many cases it will not. By way of example, a modification may only occur at a 3'- or 5'-terminal position, may only occur in a terminal region, e.g., at a position on a terminal nucleotide or in the last 2, 3, 4, 5, or 10 nucleotides of a strand. A modification may occur in a double strand region, a single strand region, or in both. A modification may occur only in the double strand region of a dsRNAi agent or may only occur in a single strand region of a dsRNAi agent. For example, a phosphorothioate modification at a non-linking O position may only occur at one or both ends, may only occur in a terminal region, e.g., at a position on a terminal nucleotide, or in the last 2, 3, 4, 5, or 10 nucleotides of a strand, or may occur in double strand and single strand regions, particularly at the ends. The 5'-end or ends can be phosphorylated.

It may be possible, e.g., to enhance stability, to include particular bases in overhangs, or to include modified nucleotides or nucleotide surrogates, in single strand overhangs, e.g., in a 5'- or 3'-overhang, or in both. For example, it can be desirable to include purine nucleotides in overhangs. In some embodiments all or some of the bases in a 3'- or 5'-overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate modifications. Overhangs need not be homologous with the target sequence.

In some embodiments, each residue of the sense strand and antisense strand is independently modified with LNA, CRN, cET, UNA, HNA, CeNA, 2'-methoxyethyl, 2'-O-methyl, 2'-O-allyl, 2'-C-allyl, 2'-deoxy, 2'-hydroxyl, or 2'-fluoro. The strands can contain more than one modification. In one embodiment, each residue of the sense strand and antisense strand is independently modified with 2'-O-methyl or 2'-fluoro.

At least two different modifications are typically present on the sense strand and antisense strand. Those two modifications may be the 2'-O-methyl or 2'-fluoro modifications, or others. In certain embodiments, the $N_a$ or $N_b$ comprise modifications of an alternating pattern. The term "alternating motif" as used herein refers to a motif having one or more modifications, each modification occurring on alternating nucleotides of one strand. The alternating nucleotide may refer to one per every other nucleotide or one per every three nucleotides, or a similar pattern. For example, if A, B and C each represent one type of modification to the nucleotide, the alternating motif can be "ABABABABAB . . . ," "AABBAABBAABB . . . ," "AABAABAABAAB . . . ," "AAABAAABAAAB . . . ," "AAABBBAAABBB . . . ," or "ABCABCABCABC . . . ," etc.

The type of modifications contained in the alternating motif may be the same or different. For example, if A, B, C, D each represent one type of modification on the nucleotide, the alternating pattern, i.e., modifications on every other nucleotide, may be the same, but each of the sense strand or antisense strand can be selected from several possibilities of modifications within the alternating motif such as "ABABAB . . . ", "ACACAC . . . " "BDBDBD . . . " or "CDCDCD . . . ," etc.

In some embodiments, the dsRNAi agent of the invention comprises the modification pattern for the alternating motif on the sense strand relative to the modification pattern for the alternating motif on the antisense strand is shifted. The shift may be such that the modified group of nucleotides of the sense strand corresponds to a differently modified group of nucleotides of the antisense strand and vice versa. For example, the sense strand when paired with the antisense strand in the dsRNA duplex, the alternating motif in the sense strand may start with "ABABAB" from 5' to 3' of the strand and the alternating motif in the antisense strand may start with "BABABA" from 5' to 3' of the strand within the duplex region. As another example, the alternating motif in the sense strand may start with "AABBAABB" from 5' to 3' of the strand and the alternating motif in the antisenese strand may start with "BBAABBAA" from 5' to 3' of the strand within the duplex region, so that there is a complete or partial shift of the modification patterns between the sense strand and the antisense strand.

In some embodiments, the dsRNAi agent comprises the pattern of the alternating motif of 2'-O-methyl modification and 2'-F modification on the sense strand initially has a shift relative to the pattern of the alternating motif of 2'-O-methyl modification and 2'-F modification on the antisense strand initially, i.e., the 2'-O-methyl modified nucleotide on the sense strand base pairs with a 2'-F modified nucleotide on the antisense strand and vice versa. The 1 position of the sense strand may start with the 2'-F modification, and the 1 position of the antisense strand may start with the 2'-O-methyl modification.

The introduction of one or more motifs of three identical modifications on three consecutive nucleotides to the sense strand or antisense strand interrupts the initial modification pattern present in the sense strand or antisense strand. This interruption of the modification pattern of the sense or antisense strand by introducing one or more motifs of three identical modifications on three consecutive nucleotides to the sense or antisense strand may enhance the gene silencing activity against the target gene.

In some embodiments, when the motif of three identical modifications on three consecutive nucleotides is introduced to any of the strands, the modification of the nucleotide next to the motif is a different modification than the modification of the motif. For example, the portion of the sequence containing the motif is " . . . $N_a$YYY$N_b$ . . . ," where "Y" represents the modification of the motif of three identical modifications on three consecutive nucleotide, and "$N_a$" and "$N_b$" represent a modification to the nucleotide next to the motif "YYY" that is different than the modification of Y, and where $N_a$ and $N_b$ can be the same or different modifications. Alternatively, $N_a$ or $N_b$ may be present or absent when there is a wing modification present.

The iRNA may further comprise at least one phosphorothioate or methylphosphonate internucleotide linkage. The phosphorothioate or methylphosphonate internucleotide linkage modification may occur on any nucleotide of the sense strand, antisense strand, or both strands in any position of the strand. For instance, the internucleotide linkage modification may occur on every nucleotide on the sense strand or antisense strand; each internucleotide linkage modification may occur in an alternating pattern on the sense strand or antisense strand; or the sense strand or antisense strand may contain both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand. In one embodiment, a double-stranded RNAi agent comprises 6-8 phosphorothioate internucleotide linkages. In some embodiments, the antisense strand comprises two phosphorothioate internucleotide linkages at the 5'-end and two phosphorothioate internucleotide linkages at the 3'-end, and the sense strand comprises at least two phosphorothioate internucleotide linkages at either the 5'-end or the 3'-end.

In some embodiments, the dsRNAi agent comprises a phosphorothioate or methylphosphonate internucleotide linkage modification in the overhang region. For example, the overhang region may contain two nucleotides having a phosphorothioate or methylphosphonate internucleotide linkage between the two nucleotides. Internucleotide linkage modifications also may be made to link the overhang nucleotides with the terminal paired nucleotides within the duplex region. For example, at least 2, 3, 4, or all the overhang nucleotides may be linked through phosphorothioate or methylphosphonate internucleotide linkage, and optionally, there may be additional phosphorothioate or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. These terminal three nucleotides may be at the 3'-end of the antisense strand, the 3'-end of the sense strand, the 5'-end of the antisense strand, or the 5' end of the antisense strand.

In some embodiments, the 2-nucleotide overhang is at the 3'-end of the antisense strand, and there are two phosphorothioate internucleotide linkages between the terminal three nucleotides, wherein two of the three nucleotides are the overhang nucleotides, and the third nucleotide is a paired nucleotide next to the overhang nucleotide. Optionally, the dsRNAi agent may additionally have two phosphorothioate internucleotide linkages between the terminal three nucleotides at both the 5'-end of the sense strand and at the 5'-end of the antisense strand.

In one embodiment, the dsRNAi agent comprises mismatch(es) with the target, within the duplex, or combinations thereof. The mismatch may occur in the overhang region or the duplex region. The base pair may be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In certain embodiments, the dsRNAi agent comprises at least one of the first 1, 2, 3, 4, or 5 base pairs within the duplex regions from the 5'-end of the antisense strand independently selected from the group of: A:U, G:U, I:C, and mismatched pairs, e.g., non-canonical or other than canonical pairings or pairings which include a universal base, to promote the dissociation of the antisense strand at the 5'-end of the duplex.

In certain embodiments, the nucleotide at the 1 position within the duplex region from the 5'-end in the antisense strand is selected from A, dA, dU, U, and dT. Alternatively, at least one of the first 1, 2, or 3 base pair within the duplex region from the 5'-end of the antisense strand is an AU base pair. For example, the first base pair within the duplex region from the 5'-end of the antisense strand is an AU base pair.

In other embodiments, the nucleotide at the 3'-end of the sense strand is deoxy-thymine (dT) or the nucleotide at the 3'-end of the antisense strand is deoxy-thymine (dT). For example, there is a short sequence of deoxy-thymine nucleotides, for example, two dT nucleotides on the 3'-end of the sense, antisense strand, or both strands.

In certain embodiments, the sense strand sequence may be represented by formula (I):

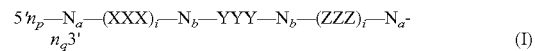
(I)

wherein:
i and j are each independently 0 or 1;
p and q are each independently 0-6;
each $N_a$ independently represents an oligonucleotide sequence comprising 0-25 modified nucleotides, each sequence comprising at least two differently modified nucleotides;
each $N_b$ independently represents an oligonucleotide sequence comprising 0-10 modified nucleotides;
each $n_p$ and $n_q$ independently represent an overhang nucleotide;
wherein Nb and Y do not have the same modification; and
XXX, YYY, and ZZZ each independently represent one motif of three identical modifications on three consecutive nucleotides. Preferably YYY is all 2'-F modified nucleotides.

In some embodiments, the $N_a$ or $N_b$ comprises modifications of alternating pattern.

In some embodiments, the YYY motif occurs at or near the cleavage site of the sense strand. For example, when the dsRNAi agent has a duplex region of 17-23 nucleotides in length, the YYY motif can occur at or the vicinity of the cleavage site (e.g.: can occur at positions 6, 7, 8; 7, 8, 9; 8, 9, 10; 9, 10, 11; 10, 11,12; or 11, 12, 13) of the sense strand, the count starting from the first nucleotide, from the 5'-end; or optionally, the count starting at the first paired nucleotide within the duplex region, from the 5'-end.

In one embodiment, i is 1 and j is 0, or i is 0 and j is 1, or both i and j are 1. The sense strand can therefore be represented by the following formulas:

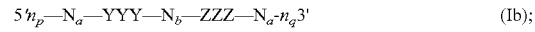
(Ib);

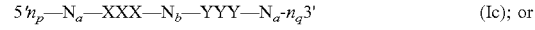
(Ic); or

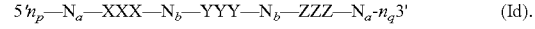
(Id).

When the sense strand is represented by formula (Ib), $N_b$ represents an oligonucleotide sequence comprising 0-10, 0-7, 0-5, 0-4, 0-2, or 0 modified nucleotides. Each $N_a$ independently can represent an oligonucleotide sequence comprising 2-20, 2-15, or 2-10 modified nucleotides.

When the sense strand is represented as formula (Ic), $N_b$ represents an oligonucleotide sequence comprising 0-10, 0-7, 0-10, 0-7, 0-5, 0-4, 0-2, or 0 modified nucleotides. Each $N_a$ can independently represent an oligonucleotide sequence comprising 2-20, 2-15, or 2-10 modified nucleotides.

When the sense strand is represented as formula (Id), each $N_b$ independently represents an oligonucleotide sequence comprising 0-10, 0-7, 0-5, 0-4, 0-2, or 0 modified nucleotides. Preferably, $N_b$ is 0, 1, 2, 3, 4, 5, or 6 Each $N_a$ can independently represent an oligonucleotide sequence comprising 2-20, 2-15, or 2-10 modified nucleotides.

Each of X, Y and Z may be the same or different from each other.

In other embodiments, i is 0 and j is 0, and the sense strand may be represented by the formula:

   (Ia).

When the sense strand is represented by formula (Ia), each $N_a$ independently can represent an oligonucleotide sequence comprising 2-20, 2-15, or 2-10 modified nucleotides.

In one embodiment, the antisense strand sequence of the RNAi may be represented by formula (II):

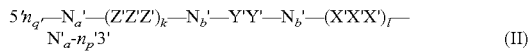   (II)

wherein:

k and l are each independently 0 or 1;

p' and q' are each independently 0-6;

each $N_a'$ independently represents an oligonucleotide sequence comprising 0-25 modified nucleotides, each sequence comprising at least two differently modified nucleotides;

each $N_b'$ independently represents an oligonucleotide sequence comprising 0-10 modified nucleotides;

each $n_p'$ and $n_q'$ independently represent an overhang nucleotide;

wherein $N_b'$ and Y' do not have the same modification; and

X'X'X', Y'Y'Y', and Z'Z'Z' each independently represent one motif of three identical modifications on three consecutive nucleotides.

In some embodiments, the $N_a'$ or $N_b'$ comprises modifications of alternating pattern.

The Y'Y'Y' motif occurs at or near the cleavage site of the antisense strand. For example, when the dsRNAi agent has a duplex region of 17-23 nucleotides in length, the Y'Y'Y' motif can occur at positions 9, 10, 11; 10, 11, 12; 11, 12, 13; 12, 13, 14; or 13, 14, 15 of the antisense strand, with the count starting from the first nucleotide, from the 5'-end; or optionally, the count starting at the first paired nucleotide within the duplex region, from the 5'-end. Preferably, the Y'Y'Y' motif occurs at positions 11, 12, 13.

In certain embodiments, Y'Y'Y' motif is all 2'-OMe modified nucleotides.

In certain embodiments, k is 1 and l is 0, or k is 0 and l is 1, or both k and l are 1.

The antisense strand can therefore be represented by the following formulas:

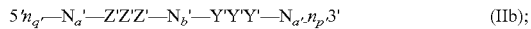   (IIb);

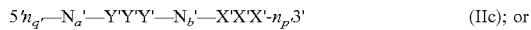   (IIc); or

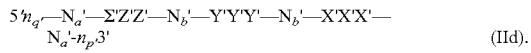   (IId).

When the antisense strand is represented by formula (IIb), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IIc), $N_b'$ represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides.

When the antisense strand is represented as formula (IId), each $N_b'$ independently represents an oligonucleotide sequence comprising 0-10, 0-7, 0-10, 0-7, 0-5, 0-4, 0-2, or 0 modified nucleotides. Each $N_a'$ independently represents an oligonucleotide sequence comprising 2-20, 2-15, or 2-10 modified nucleotides. Preferably, $N_b$ is 0, 1, 2, 3, 4, 5, or 6.

In other embodiments, k is 0 and l is 0 and the antisense strand may be represented by the formula:

   (Ia).

When the antisense strand is represented as formula (IIa), each $N_a'$ independently represents an oligonucleotide sequence comprising 2-20, 2-15, or 2-10 modified nucleotides. Each of X', Y' and Z' may be the same or different from each other.

Each nucleotide of the sense strand and antisense strand may be independently modified with LNA, CRN, UNA, cEt, HNA, CeNA, 2'-methoxyethyl, 2'-O-methyl, 2'-O-allyl, 2'-C-allyl, 2'-hydroxyl, or 2'-fluoro. For example, each nucleotide of the sense strand and antisense strand is independently modified with 2'-O-methyl or 2'-fluoro. Each X, Y, Z, X', Y', and Z', in particular, may represent a 2'-O-methyl modification or a 2'-fluoro modification.

In some embodiments, the sense strand of the dsRNAi agent may contain YYY motif occurring at 9, 10, and 11 positions of the strand when the duplex region is 21 nt, the count starting from the first nucleotide from the 5'-end, or optionally, the count starting at the first paired nucleotide within the duplex region, from the 5'-end; and Y represents 2'-F modification. The sense strand may additionally contain XXX motif or ZZZ motifs as wing modifications at the opposite end of the duplex region; and XXX and ZZZ each independently represents a 2'-OMe modification or 2'-F modification.

In some embodiments the antisense strand may contain Y'Y'Y' motif occurring at positions 11, 12, 13 of the strand, the count starting from the first nucleotide from the 5'-end, or optionally, the count starting at the first paired nucleotide within the duplex region, from the 5'-end; and Y' represents 2'-O-methyl modification. The antisense strand may additionally contain X'X'X' motif or Z'Z'Z' motifs as wing modifications at the opposite end of the duplex region; and X'X'X' and Z'Z'Z' each independently represents a 2'—OMe modification or 2'—F modification.

The sense strand represented by any one of the above formulas (Ia), (Ib), (Ic), and (Id) forms a duplex with a antisense strand being represented by any one of formulas (IIa), (IIb), (IIc), and (IId), respectively.

Accordingly, the dsRNAi agents for use in the methods of the invention may comprise a sense strand and an antisense strand, each strand having 14 to 30 nucleotides, the iRNA duplex represented by formula (III):

sense:  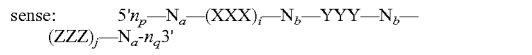

antisense:  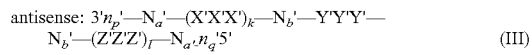   (III)

wherein:

j, k, and l are each independently 0 or 1;

p, p', q, and q' are each independently 0-6;

each $N_a$ and $N_a'$ independently represents an oligonucleotide sequence comprising 0-25 modified nucleotides, each sequence comprising at least two differently modified nucleotides;

each $N_b$ and $N_b'$ independently represents an oligonucleotide sequence comprising 0-10 modified nucleotides;

wherein each $n_p'$, $n_p$, $n_q'$, and $n_q$, each of which may or may not be present, independently represents an overhang nucleotide; and XXX, YYY, ZZZ, X'X'X', Y'Y'Y', and Z'Z'Z' each independently represent one motif of three identical modifications on three consecutive nucleotides.

In one embodiment, i is 0 and j is 0; or i is 1 and j is 0; or i is 0 and j is 1; or both i and j are 0; or both i and j are 1. In another embodiment, k is 0 and 1 is 0; or k is 1 and 1 is 0; k is 0 and 1 is 1; or both k and l are 0; or both k and 1 are 1.

Exemplary combinations of the sense strand and antisense strand forming an iRNA duplex include the formulas below:

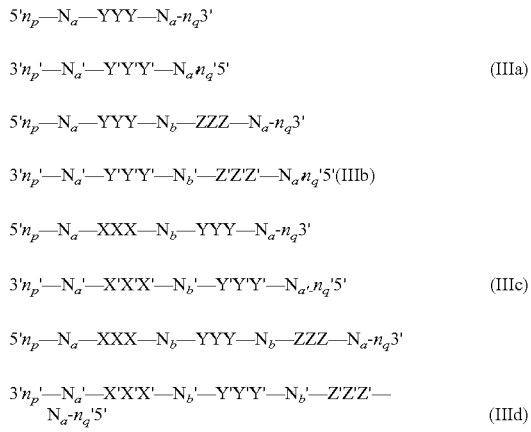

When the dsRNAi agent is represented by formula (IIIa), each $N_a$ independently represents an oligonucleotide sequence comprising 2-20, 2-15, or 2-10 modified nucleotides.

When the dsRNAi agent is represented by formula (IIIb), each $N_b$ independently represents an oligonucleotide sequence comprising 1-10, 1-7, 1-5, or 1-4 modified nucleotides. Each $N_a$ independently represents an oligonucleotide sequence comprising 2-20, 2-15, or 2-10 modified nucleotides.

When the dsRNAi agent is represented as formula (IIIc), each $N_b$, $N_b'$ independently represents an oligonucleotide sequence comprising 0-10, 0-7, 0-10, 0-7, 0-5, 0-4, 0-2, or 0 modified nucleotides. Each $N_a$ independently represents an oligonucleotide sequence comprising 2-20, 2-15, or 2-10 modified nucleotides.

When the dsRNAi agent is represented as formula (IIId), each $N_b$, $N_b'$ independently represents an oligonucleotide sequence comprising 0-10, 0-7, 0-10, 0-7, 0-5, 0-4, 0-2, or 0 modified nucleotides. Each $N_a$, $N_a'$ independently represents an oligonucleotide sequence comprising 2-20, 2-15, or 2-10 modified nucleotides. Each of $N_a$, $N_a'$, $N_b$, and $N_b'$ independently comprises modifications of alternating pattern.

Each of X, Y, and Z in formulas (III), (IIIa), (IIIb), (IIIc), and (IIId) may be the same or different from each other.

When the dsRNAi agent is represented by formula (III), (IIIa), (IIIb), (IIIc), and (IIId), at least one of the Y nucleotides may form a base pair with one of the Y' nucleotides. Alternatively, at least two of the Y nucleotides form base pairs with the corresponding Y' nucleotides; or all three of the Y nucleotides all form base pairs with the corresponding Y' nucleotides.

When the dsRNAi agent is represented by formula (IIIb) or (IIId), at least one of the Z nucleotides may form a base pair with one of the Z' nucleotides. Alternatively, at least two of the Z nucleotides form base pairs with the corresponding Z' nucleotides; or all three of the Z nucleotides all form base pairs with the corresponding Z' nucleotides.

When the dsRNAi agent is represented as formula (IIIc) or (IIId), at least one of the X nucleotides may form a base pair with one of the X' nucleotides. Alternatively, at least two of the X nucleotides form base pairs with the corresponding X' nucleotides; or all three of the X nucleotides all form base pairs with the corresponding X' nucleotides.

In certain embodiments, the modification on the Y nucleotide is different than the modification on the Y' nucleotide, the modification on the Z nucleotide is different than the modification on the Z' nucleotide, or the modification on the X nucleotide is different than the modification on the X' nucleotide.

In certain embodiments, when the dsRNAi agent is represented by formula (IIId), the $N_a$ modifications are 2'-O-methyl or 2'-fluoro modifications. In other embodiments, when the RNAi agent is represented by formula (IIId), the $N_a$ modifications are 2'-O-methyl or 2'-fluoro modifications and $n_p'>0$ and at least one $n_p'$ is linked to a neighboring nucleotide a via phosphorothioate linkage. In yet other embodiments, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, and the sense strand is conjugated to one or more GalNAc derivatives attached through a bivalent or trivalent branched linker (described below). In other embodiments, when the RNAi agent is represented by formula (IIId), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, when the dsRNAi agent is represented by formula (IIIa), the $N_a$ modifications are 2'-O-methyl or 2'-fluoro modifications, $n_p'>0$ and at least one $n_p'$ is linked to a neighboring nucleotide via phosphorothioate linkage, the sense strand comprises at least one phosphorothioate linkage, and the sense strand is conjugated to one or more GalNAc derivatives attached through a bivalent or trivalent branched linker.

In some embodiments, the dsRNAi agent is a multimer containing at least two duplexes represented by formula (III), (IIIa), (IIIb), (IIIc), and (IIId), wherein the duplexes are connected by a linker The linker can be cleavable or non-cleavable. Optionally, the multimer further comprises a ligand. Each of the duplexes can target the same gene or two different genes; or each of the duplexes can target same gene at two different target sites.

In some embodiments, the dsRNAi agent is a multimer containing three, four, five, six, or more duplexes represented by formula (III), (IIIa), (IIIb), (IIIc), and (IIId), wherein the duplexes are connected by a linker The linker can be cleavable or non-cleavable. Optionally, the multimer further comprises a ligand. Each of the duplexes can target the same gene or two different genes; or each of the duplexes can target same gene at two different target sites.

In one embodiment, two dsRNAi agents represented by at least one of formulas (III), (IIIa), (IIIb), (IIIc), and (IIId) are linked to each other at the 5' end, and one or both of the 3' ends, and are optionally conjugated to to a ligand. Each of the agents can target the same gene or two different genes; or each of the agents can target same gene at two different target sites.

Various publications describe multimeric iRNAs that can be used in the methods of the invention. Such publications include WO2007/091269, U.S. Pat. No. 7,858,769, WO2010/141511, WO2007/117686, WO2009/014887, and WO2011/031520 the entire contents of each of which are hereby incorporated herein by reference.

As described in more detail below, the iRNA that contains conjugations of one or more carbohydrate moieties to an iRNA can optimize one or more properties of the iRNA. In many cases, the carbohydrate moiety will be attached to a modified subunit of the iRNA. For example, the ribose sugar of one or more ribonucleotide subunits of a iRNA can be replaced with another moiety, e.g., a non-carbohydrate (preferably cyclic) carrier to which is attached a carbohydrate ligand. A ribonucleotide subunit in which the ribose sugar of the subunit has been so replaced is referred to herein as a ribose replacement modification subunit (RRMS). A cyclic carrier may be a carbocyclic ring system, i.e., all ring atoms are carbon atoms, or a heterocyclic ring system, i.e., one or more ring atoms may be a heteroatom, e.g., nitrogen, oxygen, sulfur. The cyclic carrier may be a monocyclic ring system, or may contain two or more rings, e.g. fused rings. The cyclic carrier may be a fully saturated ring system, or it may contain one or more double bonds.

The ligand may be attached to the polynucleotide via a carrier. The carriers include (i) at least one "backbone attachment point," preferably two "backbone attachment points" and (ii) at least one "tethering attachment point." A "backbone attachment point" as used herein refers to a functional group, e.g. a hydroxyl group, or generally, a bond available for, and that is suitable for incorporation of the carrier into the backbone, e.g., the phosphate, or modified phosphate, e.g., sulfur containing, backbone, of a ribonucleic acid. A "tethering attachment point" (TAP) in some embodiments refers to a constituent ring atom of the cyclic carrier, e.g., a carbon atom or a heteroatom (distinct from an atom which provides a backbone attachment point), that connects a selected moiety. The moiety can be, e.g., a carbohydrate, e.g. monosaccharide, disaccharide, trisaccharide, tetrasaccharide, oligosaccharide, or polysaccharide. Optionally, the selected moiety is connected by an intervening tether to the cyclic carrier. Thus, the cyclic carrier will often include a functional group, e.g., an amino group, or generally, provide a bond, that is suitable for incorporation or tethering of another chemical entity, e.g., a ligand to the constituent ring.

The iRNA may be conjugated to a ligand via a carrier, wherein the carrier can be cyclic group or acyclic group; preferably, the cyclic group is selected from pyrrolidinyl, pyrazolinyl, pyrazolidinyl, imidazolinyl, imidazolidinyl, piperidinyl, piperazinyl, [1,3]dioxolane, oxazolidinyl, isoxazolidinyl, morpholinyl, thiazolidinyl, isothiazolidinyl, quinoxalinyl, pyridazinonyl, tetrahydrofuryl, and decalin; preferably, the acyclic group is a serinol backbone or diethanolamine backbone.

In certain embodiments, the iRNA for use in the methods of the invention is an agent selected from agents listed in Table 3, Table 4, Table 6 or Table 7. These agents may further comprise a ligand.

III. iRNAs Conjugated to Ligands

Another modification of the RNA of an iRNA of the invention involves chemically linking to the iRNA one or more ligands, moieties or conjugates that enhance the activity, cellular distribution, or cellular uptake of the iRNA e.g., into a cell. Such moieties include but are not limited to lipid moieties such as a cholesterol moiety (Letsinger et al., *Proc. Natl. Acid. Sci. USA,* 1989, 86: 6553-6556), cholic acid (Manoharan et al., *Biorg. Med. Chem. Let.,* 1994, 4:1053-1060), a thioether, e.g., beryl-S-tritylthiol (Manoharan et al., *Ann. N.Y. Acad. Sci.,* 1992, 660:306-309; Manoharan et al., *Biorg. Med. Chem. Let.,* 1993, 3:2765-2770), a thiocholesterol (Oberhauser et al., *Nucl. Acids Res.,* 1992, 20:533-538), an aliphatic chain, e.g., dodecandiol or undecyl residues (Saison-Behmoaras et al., *EMBO J,* 1991, 10:1111-1118; Kabanov et al., *FEBS Lett.,* 1990, 259:327-330; Svinarchuk et al., *Biochimie,* 1993, 75:49-54), a phospholipid, e.g., di-hexadecyl-rac-glycerol or triethyl-ammonium 1,2-di-O-hexadecyl-rac-glycero-3-phosphonate (Manoharan et al., *Tetrahedron Lett.,* 1995, 36:3651-3654; Shea et al., *Nucl. Acids Res.,* 1990, 18:3777-3783), a polyamine or a polyethylene glycol chain (Manoharan et al., *Nucleosides & Nucleotides,* 1995, 14:969-973), or adamantane acetic acid (Manoharan et al., *Tetrahedron Lett.,* 1995, 36:3651-3654), a palmityl moiety (Mishra et al., *Biochim. Biophys. Acta,* 1995, 1264:229-237), or an octadecylamine or hexylaminocarbonyloxycholesterol moiety (Crooke et al., *J. Pharmacol. Exp. Ther.,* 1996, 277:923-937).

In certain embodiments, a ligand alters the distribution, targeting or lifetime of an iRNA agent into which it is incorporated. In preferred embodiments a ligand provides an enhanced affinity for a selected target, e.g., molecule, cell or cell type, compartment, e.g., a cellular or organ compartment, tissue, organ or region of the body, as, e.g., compared to a species absent such a ligand. Preferred ligands do not take part in duplex pairing in a duplexed nucleic acid.

Ligands can include a naturally occurring substance, such as a protein (e.g., human serum albumin (HSA), low-density lipoprotein (LDL), or globulin); carbohydrate (e.g., a dextran, pullulan, chitin, chitosan, inulin, cyclodextrin, N-acetylgalactosamine, or hyaluronic acid); or a lipid. The ligand can also be a recombinant or synthetic molecule, such as a synthetic polymer, e.g., a synthetic polyamino acid. Examples of polyamino acids include polyamino acid is a polylysine (PLL), poly L-aspartic acid, poly L-glutamic acid, styrene-maleic acid anhydride copolymer, poly(L-lactide-co-glycolied) copolymer, divinyl ether-maleic anhydride copolymer, N-(2-hydroxypropyl)methacrylamide copolymer (HMPA), polyethylene glycol (PEG), polyvinyl alcohol (PVA), polyurethane, poly(2-ethylacryllic acid), N-isopropylacrylamide polymers, or polyphosphazine Example of polyamines include: polyethylenimine, polylysine (PLL), spermine, spermidine, polyamine, pseudopeptide-polyamine, peptidomimetic polyamine, dendrimer polyamine, arginine, amidine, protamine, cationic lipid, cationic porphyrin, quaternary salt of a polyamine, or an alpha helical peptide.

Ligands can also include targeting groups, e.g., a cell or tissue targeting agent, e.g., a lectin, glycoprotein, lipid or protein, e.g., an antibody, that binds to a specified cell type such as a kidney cell. A targeting group can be a thyrotropin, melanotropin, lectin, glycoprotein, surfactant protein A, Mucin carbohydrate, multivalent lactose, multivalent galactose, N-acetyl-galactosamine, N-acetyl-glucoseamine multivalent mannose, multivalent fucose, glycosylated polyaminoacids, galactose, transferrin, bisphosphonate, polyglutamate, polyaspartate, a lipid, cholesterol, a steroid, bile acid, folate, vitamin B12, vitamin A, biotin, or an RGD peptide or RGD peptide mimetic.

Other examples of ligands include dyes, intercalating agents (e.g. acridines), cross-linkers (e.g. psoralen, mitomycin C), porphyrins (TPPC4, texaphyrin, Sapphyrin), polycyclic aromatic hydrocarbons (e.g., phenazine, dihydrophenazine), artificial endonucleases (e.g. EDTA), lipophilic molecules, e.g., cholesterol, cholic acid, adamantane acetic acid, 1-pyrene butyric acid, dihydrotestosterone, 1,3-Bis-O (hexadecyl)glycerol, geranyloxyhexyl group, hexadecylglycerol, borneol, menthol, 1,3-propanediol, heptadecyl group, palmitic acid, myristic acid,O3-(oleoyl)

lithocholic acid, O3-(oleoyl)cholenic acid, dimethoxytrityl, or phenoxazine) and peptide conjugates (e.g., antennapedia peptide, Tat peptide), alkylating agents, phosphate, amino, mercapto, PEG (e.g., PEG-40K), MPEG, [MPEG]$_2$, polyamino, alkyl, substituted alkyl, radiolabeled markers, enzymes, haptens (e.g. biotin), transport/absorption facilitators (e.g., aspirin, vitamin E, folic acid), synthetic ribonucleases (e.g., imidazole, bisimidazole, histamine, imidazole clusters, acridine-imidazole conjugates, Eu3+ complexes of tetraazamacrocycles), dinitrophenyl, HRP, or AP.

Ligands can be proteins, e.g., glycoproteins, or peptides, e.g., molecules having a specific affinity for a co-ligand, or antibodies e.g., an antibody, that binds to a specified cell type such as a hepatic cell. Ligands can also include hormones and hormone receptors. They can also include non-peptidic species, such as lipids, lectins, carbohydrates, vitamins, cofactors, multivalent lactose, multivalent galactose, N-acetyl-galactosamine, N-acetyl-gulucosamine multivalent mannose, or multivalent fucose. The ligand can be, for example, a lipopolysaccharide, an activator of p38 MAP kinase, or an activator of NF-κB.

The ligand can be a substance, e.g., a drug, which can increase the uptake of the iRNA agent into the cell, for example, by disrupting the cell's cytoskeleton, e.g., by disrupting the cell's microtubules, microfilaments, or intermediate filaments. The drug can be, for example, taxon, vincristine, vinblastine, cytochalasin, nocodazole, japlakinolide, latrunculin A, phalloidin, swinholide A, indanocine, or myoservin.

In some embodiments, a ligand attached to an iRNA as described herein acts as a pharmacokinetic modulator (PK modulator). PK modulators include lipophiles, bile acids, steroids, phospholipid analogues, peptides, protein binding agents, PEG, vitamins etc. Exemplary PK modulators include, but are not limited to, cholesterol, fatty acids, cholic acid, lithocholic acid, dialkylglycerides, diacylglyceride, phospholipids, sphingolipids, naproxen, ibuprofen, vitamin E, biotin etc. Oligonucleotides that comprise a number of phosphorothioate linkages are also known to bind to serum protein, thus short oligonucleotides, e.g., oligonucleotides of about 5 bases, 10 bases, 15 bases, or 20 bases, comprising multiple of phosphorothioate linkages in the backbone are also amenable to the present invention as ligands (e.g. as PK modulating ligands). In addition, aptamers that bind serum components (e.g. serum proteins) are also suitable for use as PK modulating ligands in the embodiments described herein.

Ligand-conjugated iRNAs of the invention may be synthesized by the use of an oligonucleotide that bears a pendant reactive functionality, such as that derived from the attachment of a linking molecule onto the oligonucleotide (described below). This reactive oligonucleotide may be reacted directly with commercially-available ligands, ligands that are synthesized bearing any of a variety of protecting groups, or ligands that have a linking moiety attached thereto.

The oligonucleotides used in the conjugates of the present invention may be conveniently and routinely made through the well-known technique of solid-phase synthesis. Equipment for such synthesis is sold by several vendors including, for example, Applied Biosystems (Foster City, Calif.). Any other means for such synthesis known in the art may additionally or alternatively be employed. It is also known to use similar techniques to prepare other oligonucleotides, such as the phosphorothioates and alkylated derivatives.

In the ligand-conjugated iRNAs and ligand-molecule bearing sequence-specific linked nucleosides of the present invention, the oligonucleotides and oligonucleosides may be assembled on a suitable DNA synthesizer utilizing standard nucleotide or nucleoside precursors, or nucleotide or nucleoside conjugate precursors that already bear the linking moiety, ligand-nucleotide or nucleoside-conjugate precursors that already bear the ligand molecule, or non-nucleoside ligand-bearing building blocks.

When using nucleotide-conjugate precursors that already bear a linking moiety, the synthesis of the sequence-specific linked nucleosides is typically completed, and the ligand molecule is then reacted with the linking moiety to form the ligand-conjugated oligonucleotide. In some embodiments, the oligonucleotides or linked nucleosides of the present invention are synthesized by an automated synthesizer using phosphoramidites derived from ligand-nucleoside conjugates in addition to the standard phosphoramidites and non-standard phosphoramidites that are commercially available and routinely used in oligonucleotide synthesis.

A. Lipid Conjugates

In certain embodiments, the ligand or conjugate is a lipid or lipid-based molecule. Such a lipid or lipid-based molecule preferably binds a serum protein, e.g., human serum albumin (HSA). An HSA binding ligand allows for distribution of the conjugate to a target tissue, e.g., a non-kidney target tissue of the body. For example, the target tissue can be the liver, including parenchymal cells of the liver. Other molecules that can bind HSA can also be used as ligands. For example, naproxen or aspirin can be used. A lipid or lipid-based ligand can (a) increase resistance to degradation of the conjugate, (b) increase targeting or transport into a target cell or cell membrane, or (c) can be used to adjust binding to a serum protein, e.g., HSA.

A lipid based ligand can be used to inhibit, e.g., control the binding of the conjugate to a target tissue. For example, a lipid or lipid-based ligand that binds to HSA more strongly will be less likely to be targeted to the kidney and therefore less likely to be cleared from the body. A lipid or lipid-based ligand that binds to HSA less strongly can be used to target the conjugate to the kidney.

In certain embodiments, the lipid based ligand binds HSA. Preferably, it binds HSA with a sufficient affinity such that the conjugate will be preferably distributed to a non-kidney tissue. However, it is preferred that the affinity not be so strong that the HSA-ligand binding cannot be reversed.

In other embodiments, the lipid based ligand binds HSA weakly or not at all, such that the conjugate will be preferably distributed to the kidney. Other moieties that target to kidney cells can also be used in place of, or in addition to, the lipid based ligand.

In another aspect, the ligand is a moiety, e.g., a vitamin, which is taken up by a target cell, e.g., a proliferating cell. These are particularly useful for treating disorders characterized by unwanted cell proliferation, e.g., of the malignant or non-malignant type, e.g., cancer cells. Exemplary vitamins include vitamin A, E, and K. Other exemplary vitamins include are B vitamin, e.g., folic acid, B12, riboflavin, biotin, pyridoxal or other vitamins or nutrients taken up by target cells such as liver cells. Also included are HSA and low density lipoprotein (LDL).

B. Cell Permeation Agents In another aspect, the ligand is a cell-permeation agent, preferably a helical cell-permeation agent. Preferably, the agent is amphipathic. An exemplary agent is a peptide such as tat or antennopedia. If the agent is a peptide, it can be modified, including a peptidylmimetic, invertomers, non-peptide or pseudo-peptide linkages, and use of D-amino acids. The helical agent is preferably an alpha-helical agent, which preferably has a lipophilic and a lipophobic phase.

The ligand can be a peptide or peptidomimetic. A peptidomimetic (also referred to herein as an oligopeptidomimetic) is a molecule capable of folding into a defined three-dimensional structure similar to a natural peptide. The attachment of peptide and peptidomimetics to iRNA agents can affect pharmacokinetic distribution of the iRNA, such as by enhancing cellular recognition and absorption. The peptide or peptidomimetic moiety can be about 5-50 amino acids long, e.g., about 5, 10, 15, 20, 25, 30, 35, 40, 45, or 50 amino acids long.

A peptide or peptidomimetic can be, for example, a cell permeation peptide, cationic peptide, amphipathic peptide, or hydrophobic peptide (e.g., consisting primarily of Tyr, Trp, or Phe). The peptide moiety can be a dendrimer peptide, constrained peptide or crosslinked peptide. In another alternative, the peptide moiety can include a hydrophobic membrane translocation sequence (MTS). An exemplary hydrophobic MTS-containing peptide is RFGF having the amino acid sequence AAVALLPAVLLALLAP (SEQ ID NO:11). An RFGF analogue (e.g., amino acid sequence AALLPVLLAAP (SEQ ID NO:12) containing a hydrophobic MTS can also be a targeting moiety. The peptide moiety can be a "delivery" peptide, which can carry large polar molecules including peptides, oligonucleotides, and protein across cell membranes. For example, sequences from the HIV Tat protein (GRKKRRQRRRPPQ (SEQ ID NO:13) and the *Drosophila* Antennapedia protein (RQIKIWFQNRRMKWKK (SEQ ID NO:14) have been found to be capable of functioning as delivery peptides. A peptide or peptidomimetic can be encoded by a random sequence of DNA, such as a peptide identified from a phage-display library, or one-bead-one-compound (OBOC) combinatorial library (Lam et al., Nature, 354:82-84, 1991). Examples of a peptide or peptidomimetic tethered to a dsRNA agent via an incorporated monomer unit for cell targeting purposes is an arginine-glycine-aspartic acid (RGD)-peptide, or RGD mimic. A peptide moiety can range in length from about 5 amino acids to about 40 amino acids. The peptide moieties can have a structural modification, such as to increase stability or direct conformational properties. Any of the structural modifications described below can be utilized An RGD peptide for use in the compositions and methods of the invention may be linear or cyclic, and may be modified, e.g., glycosylated or methylated, to facilitate targeting to a specific tissue(s). RGD-containing peptides and peptidiomimemtics may include D-amino acids, as well as synthetic RGD mimics. In addition to RGD, one can use other moieties that target the integrin ligand. Preferred conjugates of this ligand target PECAM-1 or VEGF.

A "cell permeation peptide" is capable of permeating a cell, e.g., a microbial cell, such as a bacterial or fungal cell, or a mammalian cell, such as a human cell. A microbial cell-permeating peptide can be, for example, an α-helical linear peptide (e.g., LL-37 or Ceropin P1), a disulfide bond-containing peptide (e.g., α-defensin, β-defensin or bactenecin), or a peptide containing only one or two dominating amino acids (e.g., PR-39 or indolicidin). A cell permeation peptide can also include a nuclear localization signal (NLS). For example, a cell permeation peptide can be a bipartite amphipathic peptide, such as MPG, which is derived from the fusion peptide domain of HIV-1 gp41 and the NLS of SV40 large T antigen (Simeoni et al., Nucl. Acids Res. 31:2717-2724, 2003).

C. Carbohydrate Conjugates

In some embodiments of the compositions and methods of the invention, an iRNA further comprises a carbohydrate. The carbohydrate conjugated iRNA is advantageous for the in vivo delivery of nucleic acids, as well as compositions suitable for in vivo therapeutic use, as described herein. As used herein, "carbohydrate" refers to a compound which is either a carbohydrate per se made up of one or more monosaccharide units having at least 6 carbon atoms (which can be linear, branched or cyclic) with an oxygen, nitrogen or sulfur atom bonded to each carbon atom; or a compound having as a part thereof a carbohydrate moiety made up of one or more monosaccharide units each having at least six carbon atoms (which can be linear, branched or cyclic), with an oxygen, nitrogen or sulfur atom bonded to each carbon atom. Representative carbohydrates include the sugars (mono-, di-, tri-, and oligosaccharides containing from about 4, 5, 6, 7, 8, or 9 monosaccharide units), and polysaccharides such as starches, glycogen, cellulose and polysaccharide gums. Specific monosaccharides include C5 and above (e.g., C5, C6, C7, or C8) sugars; di- and trisaccharides include sugars having two or three monosaccharide units (e.g., C5, C6, C7, or C8).

In one embodiment, a carbohydrate conjugate for use in the compositions and methods of the invention is a monosaccharide. In another embodiment, a carbohydrate conjugate for use in the compositions and methods of the invention is selected from the group consisting of:

Formula II

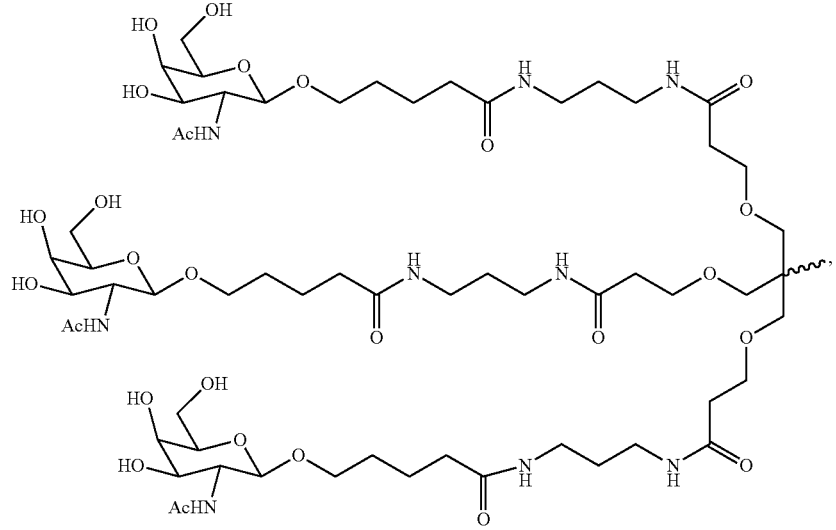

-continued
Formula III
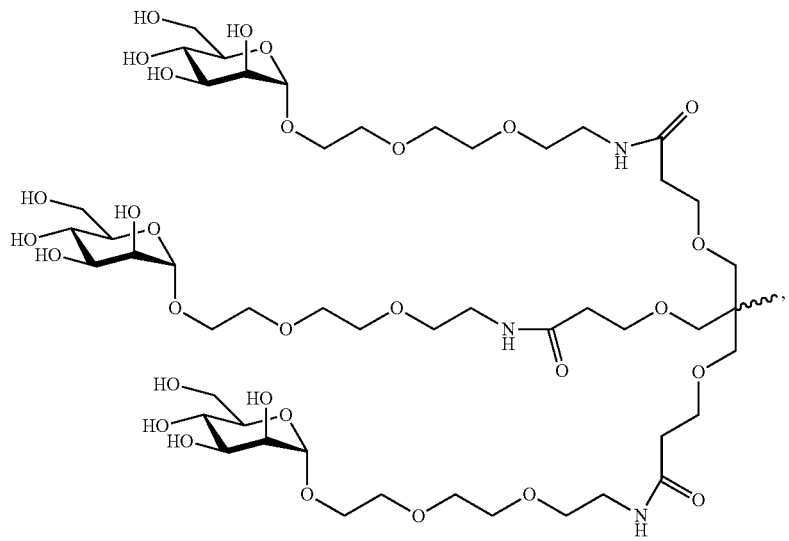
Formula IV
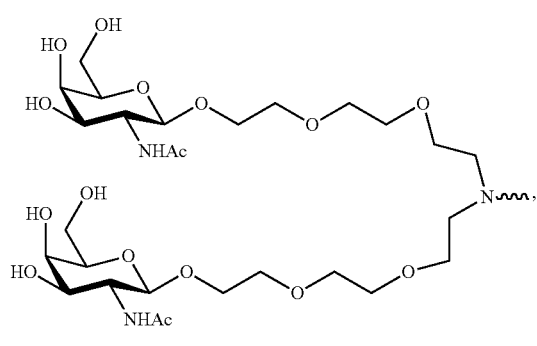
Formula V
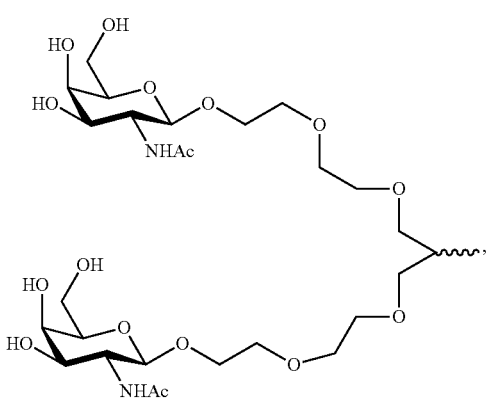
Formula VI
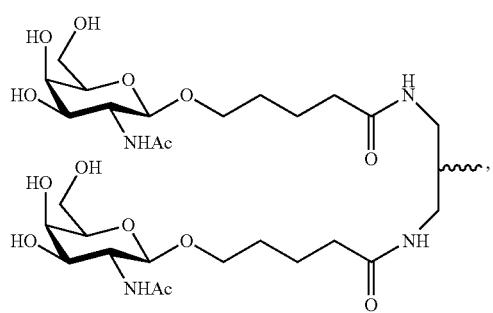
Formula VII
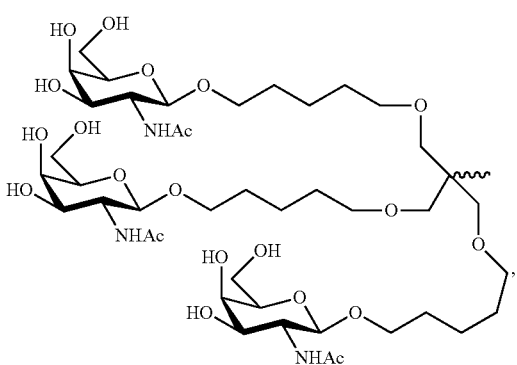
Formula VIII
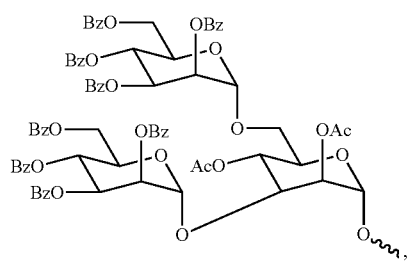

-continued
Formula IX
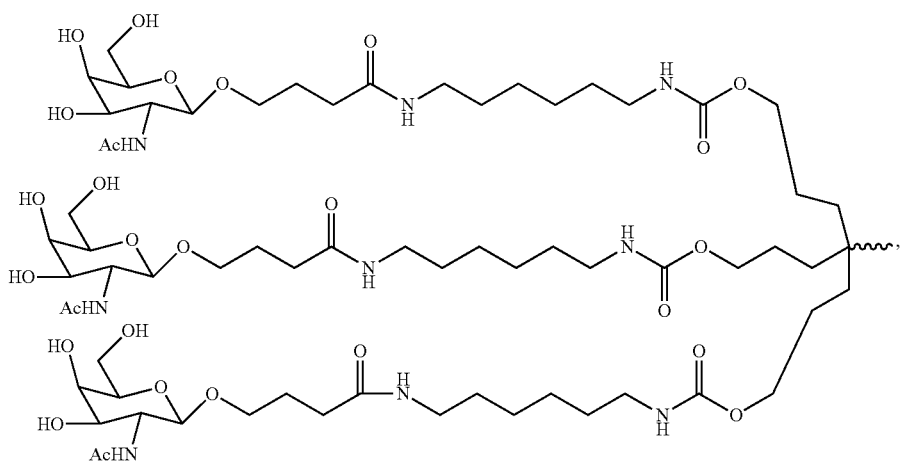
Formula X
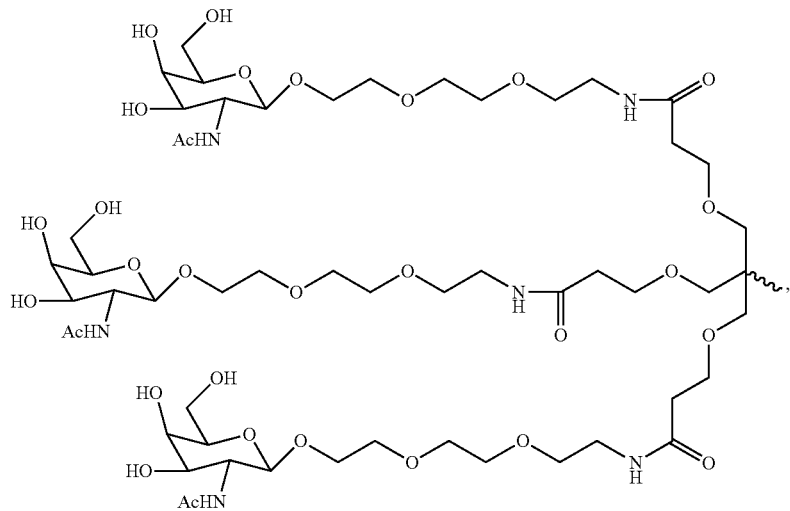
Formula XI
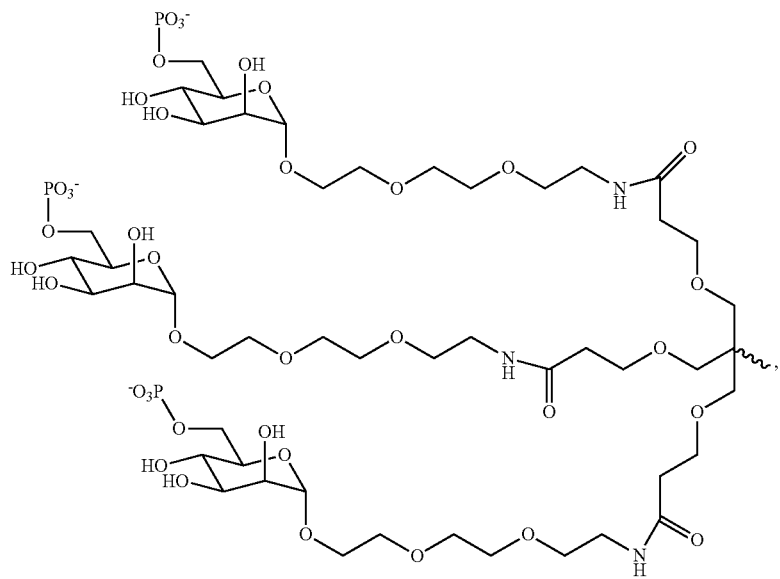

-continued
Formula XII
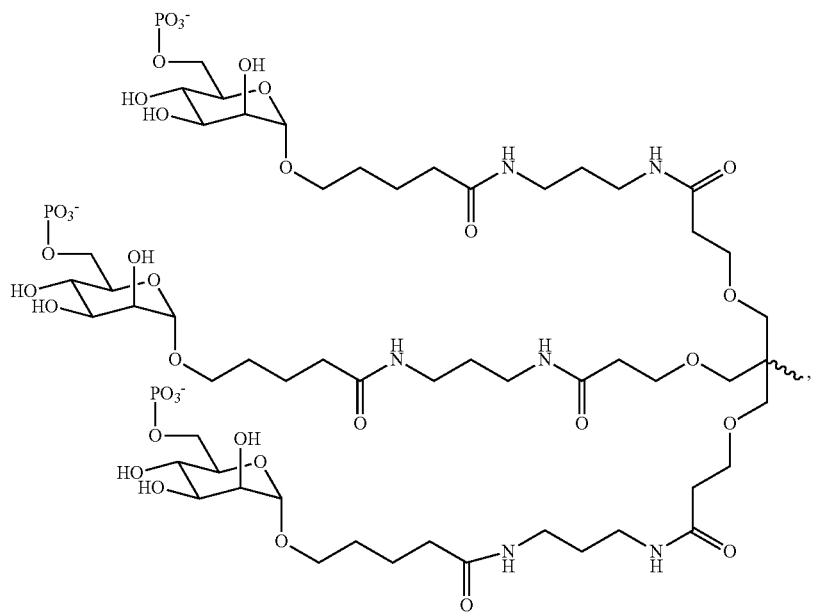
Formula XIII
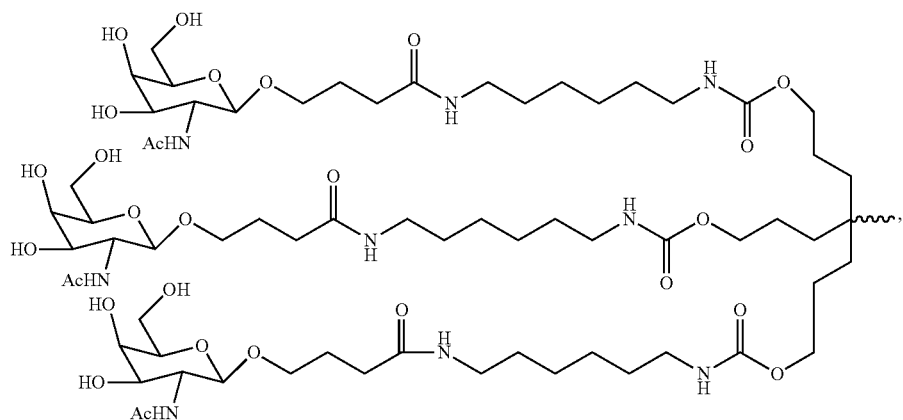
Formula XIV
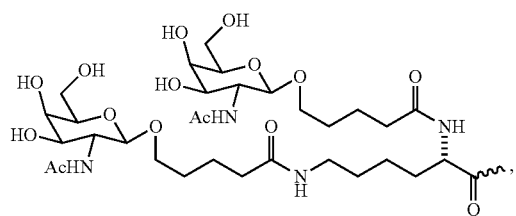
Formula XV
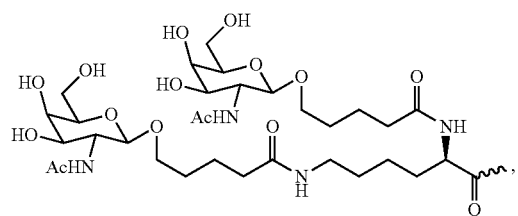
Formula XVI
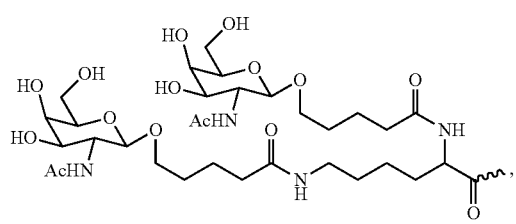
Formula XVII
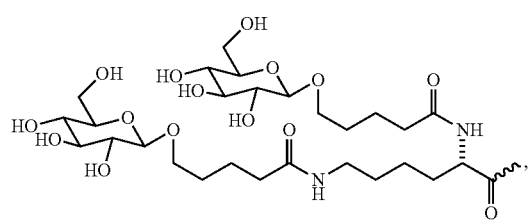

-continued
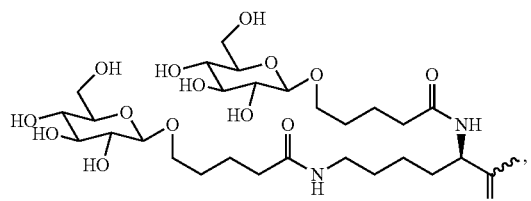
Formula XVIII
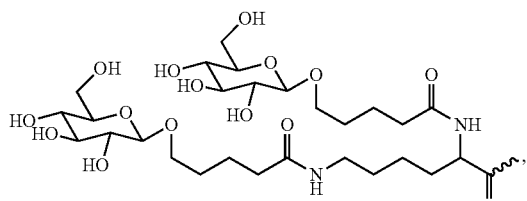
Formula XIX
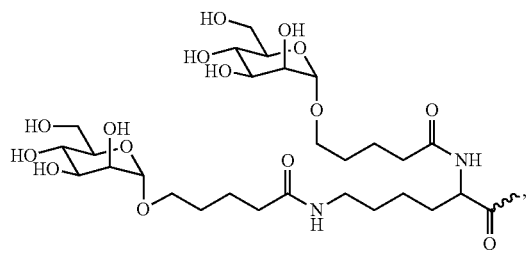
Formula XX
Formula XXI
Formula XXII
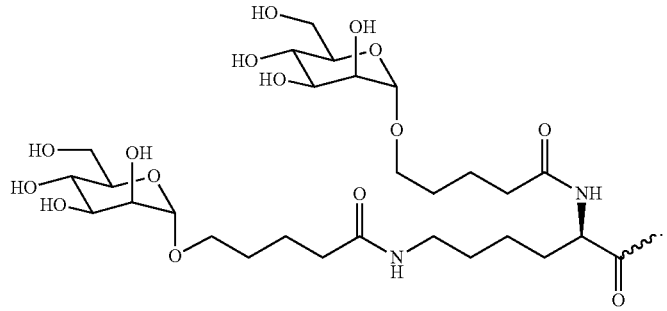
In one embodiment, the monosaccharide is an N-acetyl-galactosamine, such as
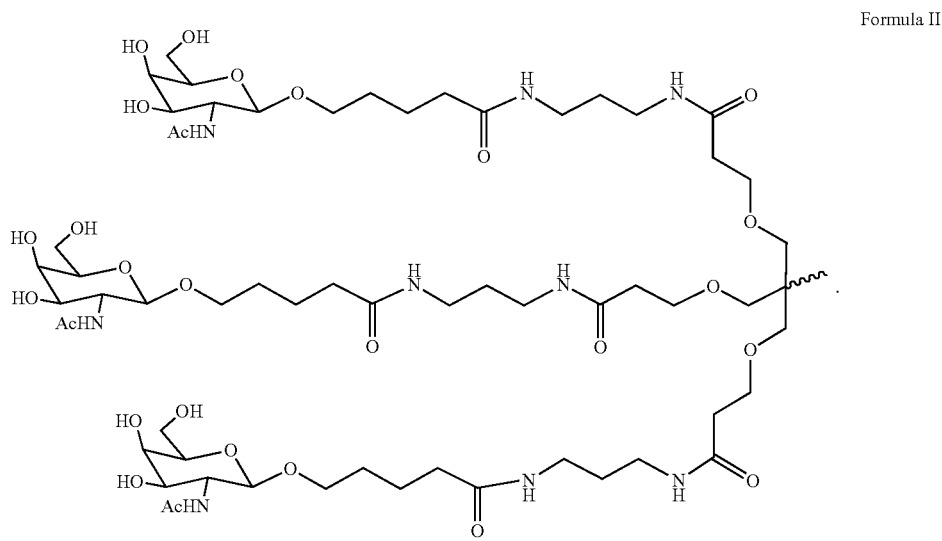 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]
Formula II
Another representative carbohydrate conjugate for use in the embodiments described herein includes, but is not limited to,

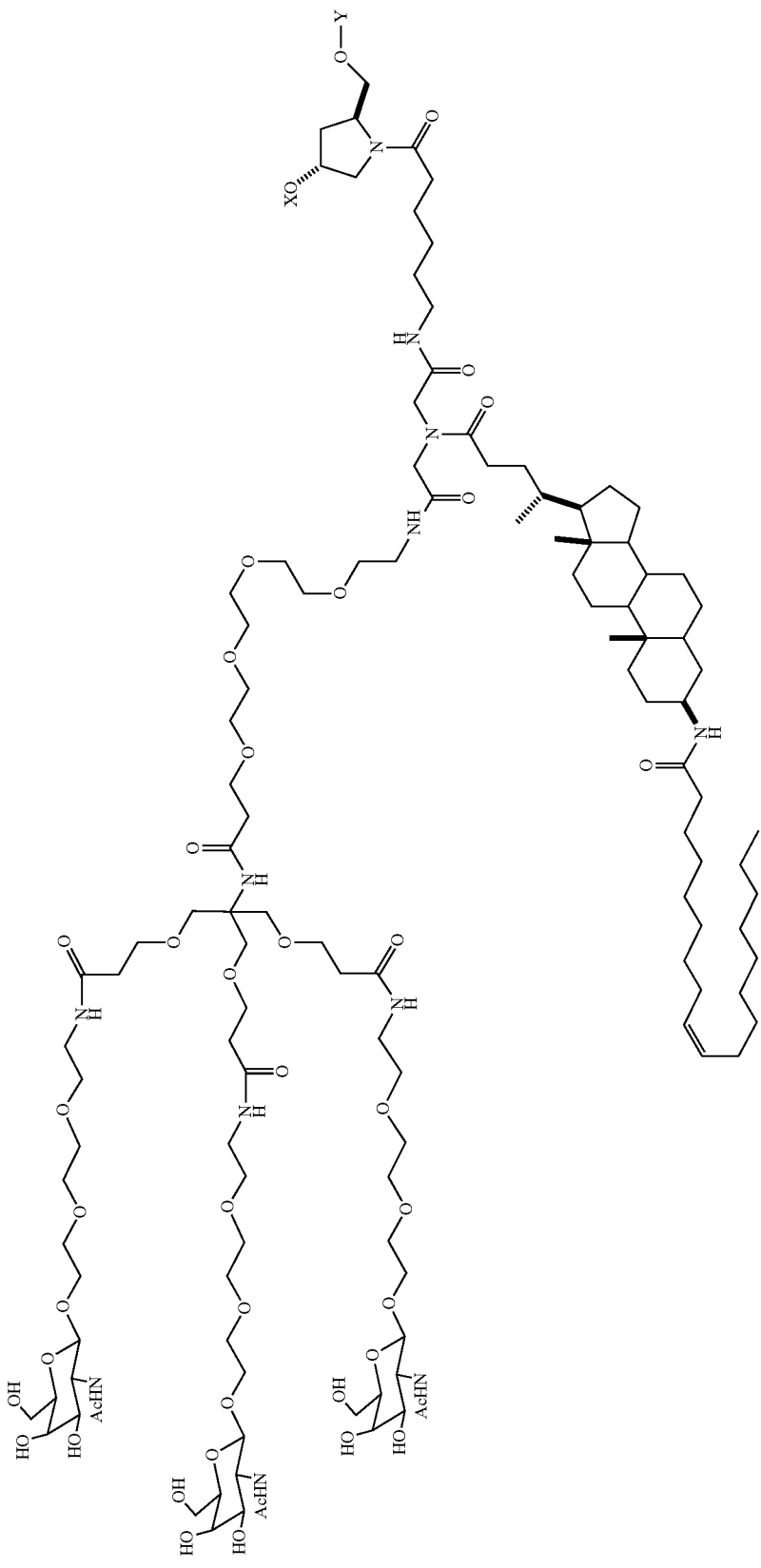

(Formula XXIII), when one of X or Y is an oligonucleotide, the other is a hydrogen.

In certain embodiments of the invention, the GalNAc or GalNAc derivative is attached to an iRNA agent of the invention via a monovalent linker. In some embodiments, the GalNAc or GalNAc derivative is attached to an iRNA agent of the invention via a bivalent linker. In yet other embodiments of the invention, the GalNAc or GalNAc derivative is attached to an iRNA agent of the invention via a trivalent linker.

In one embodiment, the double stranded RNAi agents of the invention comprise one GalNAc or GalNAc derivative attached to the iRNA agent. In another embodiment, the double stranded RNAi agents of the invention comprise a plurality (e.g., 2, 3, 4, 5, or 6) GalNAc or GalNAc derivatives, each independently attached to a plurality of nucleotides of the double stranded RNAi agent through a plurality of monovalent linkers.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, for example, when the two strands of an iRNA agent of the invention are part of one larger molecule connected by an uninterrupted chain of nucleotides between the 3'-end of one strand and the 5'-end of the respective other strand forming a hairpin loop comprising, a plurality of unpaired nucleotides, each unpaired nucleotide within the hairpin loop may independently comprise a GalNAc or GalNAc derivative attached via a monovalent linker. The hairpin loop may also be formed by an extended overhang in one strand of the duplex.

In some embodiments, the carbohydrate conjugate further comprises one or more additional ligands as described above, such as, but not limited to, a PK modulator or a cell permeation peptide.

Additional carbohydrate conjugates suitable for use in the present invention include those described in PCT Publication Nos. WO 2014/179620 and WO 2014/179627, the entire contents of each of which are incorporated herein by reference.

D. Linkers

In some embodiments, the conjugate or ligand described herein can be attached to an iRNA oligonucleotide with various linkers that can be cleavable or non-cleavable.

The term "linker" or "linking group" means an organic moiety that connects two parts of a compound, e.g., covalently attaches two parts of a compound. Linkers typically comprise a direct bond or an atom such as oxygen or sulfur, a unit such as NR8, C(O), C(O)NH, SO, $SO_2$, $SO_2$NH or a chain of atoms, such as, but not limited to, substituted or unsubstituted alkyl, substituted or unsubstituted alkenyl, substituted or unsubstituted alkynyl, arylalkyl, arylalkenyl, arylalkynyl, heteroarylalkyl, heteroarylalkenyl, heteroarylalkynyl, heterocyclylalkyl, heterocyclylalkenyl, heterocyclylalkynyl, aryl, heteroaryl, heterocyclyl, cycloalkyl, cycloalkenyl, alkylarylalkyl, alkylarylalkenyl, alkylarylalkynyl, alkenylarylalkyl, alkenylarylalkenyl, alkenylarylalkynyl, alkynylarylalkyl, alkynylarylalkenyl, alkynylarylalkynyl, alkylheteroarylalkyl, alkylheteroarylalkenyl, alkylheteroarylalkynyl, alkenylheteroarylalkyl, alkenylheteroarylalkenyl, alkenylheteroarylalkynyl, alkynylheteroarylalkyl, alkynylheteroarylalkenyl, alkynylheteroarylalkynyl, alkylheterocyclylalkyl, alkylheterocyclylalkenyl, alkylhererocyclylalkynyl, alkenylheterocyclylalkyl, alkenylheterocyclylalkenyl, alkenylheterocyclylalkynyl, alkynylheterocyclylalkyl, alkynylheterocyclylalkenyl, alkynylheterocyclylalkynyl, alkylaryl, alkenylaryl, alkynylaryl, alkylheteroaryl, alkenylheteroaryl, alkynylhereroaryl, which one or more methylenes can be interrupted or terminated by O, S, S(O), $SO_2$, N(R8), C(O), substituted or unsubstituted aryl, substituted or unsubstituted heteroaryl, or substituted or unsubstituted heterocyclic; where R8 is hydrogen, acyl, aliphatic, or substituted aliphatic. In one embodiment, the linker is about 1-24 atoms, 2-24, 3-24, 4-24, 5-24, 6-24, 6-18, 7-18, 8-18, 7-17, 8-17, 6-16, 7-16, or 8-16 atoms.

A cleavable linking group is one which is sufficiently stable outside the cell, but which upon entry into a target cell is cleaved to release the two parts the linker is holding together. In a preferred embodiment, the cleavable linking group is cleaved at least 10 times, 20, times, 30 times, 40 times, 50 times, 60 times, 70 times, 80 times, 90 times, or 100 times faster in a target cell or under a first reference condition (which can, e.g., be selected to mimic or represent intracellular conditions) than in the blood of a subject, or under a second reference condition (which can, e.g., be selected to mimic or represent conditions found in the blood or serum).

Cleavable linking groups are susceptible to cleavage agents, e.g., pH, redox potential, or the presence of degradative molecules. Generally, cleavage agents are more prevalent or found at higher levels or activities inside cells than in serum or blood. Examples of such degradative agents include: redox agents which are selected for particular substrates or which have no substrate specificity, including, e.g., oxidative or reductive enzymes or reductive agents such as mercaptans, present in cells, that can degrade a redox cleavable linking group by reduction; esterases; endosomes or agents that can create an acidic environment, e.g., those that result in a pH of five or lower; enzymes that can hydrolyze or degrade an acid cleavable linking group by acting as a general acid, peptidases (which can be substrate specific), and phosphatases.

A cleavable linkage group, such as a disulfide bond can be susceptible to pH. The pH of human serum is 7.4, while the average intracellular pH is slightly lower, ranging from about 7.1-7.3. Endosomes have a more acidic pH, in the range of 5.5-6.0, and lysosomes have an even more acidic pH at around 5.0. Some linkers will have a cleavable linking group that is cleaved at a preferred pH, thereby releasing a cationic lipid from the ligand inside the cell, or into the desired compartment of the cell.

A linker can include a cleavable linking group that is cleavable by a particular enzyme. The type of cleavable linking group incorporated into a linker can depend on the cell to be targeted. For example, a liver-targeting ligand can be linked to a cationic lipid through a linker that includes an ester group. Liver cells are rich in esterases, and therefore the linker will be cleaved more efficiently in liver cells than in cell types that are not esterase-rich. Other cell-types rich in esterases include cells of the lung, renal cortex, and testis.

Linkers that contain peptide bonds can be used when targeting cell types rich in peptidases, such as liver cells and synoviocytes.

In general, the suitability of a candidate cleavable linking group can be evaluated by testing the ability of a degradative agent (or condition) to cleave the candidate linking group. It will also be desirable to also test the candidate cleavable linking group for the ability to resist cleavage in the blood or when in contact with other non-target tissue. Thus, one can determine the relative susceptibility to cleavage between a first and a second condition, where the first is selected to be indicative of cleavage in a target cell and the second is selected to be indicative of cleavage in other tissues or biological fluids, e.g., blood or serum. The evaluations can be carried out in cell free systems, in cells, in cell culture, in organ or tissue culture, or in whole animals. It can be useful to make initial evaluations in cell-free or culture conditions and to confirm by further evaluations in whole animals. In preferred embodiments, useful candidate compounds are cleaved at least 2, 4, 10, 20, 30, 40, 50, 60, 70, 80, 90, or 100 times faster in the cell (or under in vitro conditions selected to mimic intracellular conditions) as compared to blood or serum (or under in vitro conditions selected to mimic extracellular conditions).

i. Redox Cleavable Linking Groups

In certain embodiments, a cleavable linking group is a redox cleavable linking group that is cleaved upon reduction or oxidation. An example of reductively cleavable linking group is a disulphide linking group (—S—S—). To determine if a candidate cleavable linking group is a suitable "reductively cleavable linking group," or for example is suitable for use with a particular iRNA moiety and particular targeting agent one can look to methods described herein. For example, a candidate can be evaluated by incubation with dithiothreitol (DTT), or other reducing agent using reagents know in the art, which mimic the rate of cleavage which would be observed in a cell, e.g., a target cell. The candidates can also be evaluated under conditions which are selected to mimic blood or serum conditions. In one, candidate compounds are cleaved by at most about 10% in the blood. In other embodiments, useful candidate compounds are degraded at least about 2, 4, 10, 20, 30, 40, 50, 60, 70, 80, 90, or about 100 times faster in the cell (or under in vitro conditions selected to mimic intracellular conditions) as compared to blood (or under in vitro conditions selected to mimic extracellular conditions). The rate of cleavage of candidate compounds can be determined using standard enzyme kinetics assays under conditions chosen to mimic intracellular media and compared to conditions chosen to mimic extracellular media.

ii. Phosphate-Based Cleavable Linking Groups

In other embodiments, a cleavable linker comprises a phosphate-based cleavable linking group. A phosphate-based cleavable linking group is cleaved by agents that degrade or hydrolyze the phosphate group. An example of an agent that cleaves phosphate groups in cells are enzymes such as phosphatases in cells. Examples of phosphate-based linking groups are —O—P(O)(ORk)-O—, —O—P(S)(ORk)-O—, —O—P(S)(SRk)-O—, —S—P(O)(ORk)-O—, —O—P(O)(ORk)-S—, —S—P(O)(ORk)-S—, —O—P(S)(ORk)-S—, —S—P(S)(ORk)-O—, —O—P(O)(Rk)-O—, —O—P(S)(Rk)-O—, —S—P(O)(Rk)-O—, —S—P(S)(Rk)-O—, —S—P(O)(Rk)-S—, —O—P(S)(Rk)-S—. Preferred embodiments are —O—P(O)(OH)—O—, —O—P(S)(OH)—O—, —O—P(S)(SH)—O—, —S—P(O)(OH)—O—, —O—P(O)(OH)—S—, —S—P(O)(OH)—S—, —O—P(S)(OH)—S—, —S—P(S)(OH)—O—, —O—P(O)(H)—O—, —O—P(S)(H)—O—, —S—P(O)(H)—O, —S—P(S)(H)—O—, —S—P(O)(H)—S—, and —O—P(S)(H)—S—. A preferred embodiment is —O—P(O)(OH)—O—. These candidates can be evaluated using methods analogous to those described above.

iii. Acid cleavable linking groups

In other embodiments, a cleavable linker comprises an acid cleavable linking group. An acid cleavable linking group is a linking group that is cleaved under acidic conditions. In preferred embodiments acid cleavable linking groups are cleaved in an acidic environment with a pH of about 6.5 or lower (e.g., about 6.0, 5.5, 5.0, or lower), or by agents such as enzymes that can act as a general acid. In a cell, specific low pH organelles, such as endosomes and lysosomes can provide a cleaving environment for acid cleavable linking groups. Examples of acid cleavable linking groups include but are not limited to hydrazones, esters, and esters of amino acids. Acid cleavable groups can have the general formula —C=NN—, C(O)O, or —OC(O). A preferred embodiment is when the carbon attached to the oxygen of the ester (the alkoxy group) is an aryl group, substituted alkyl group, or tertiary alkyl group such as dimethyl pentyl or t-butyl. These candidates can be evaluated using methods analogous to those described above.

iv. Ester-Based Linking Groups

In other embodiments, a cleavable linker comprises an ester-based cleavable linking group. An ester-based cleavable linking group is cleaved by enzymes such as esterases and amidases in cells. Examples of ester-based cleavable linking groups include, but are not limited to, esters of alkylene, alkenylene and alkynylene groups. Ester cleavable linking groups have the general formula —C(O)O—, or —OC(O)—. These candidates can be evaluated using methods analogous to those described above.

v. Peptide-Based Cleaving Groups

In yet other embodiments, a cleavable linker comprises a peptide-based cleavable linking group. A peptide-based cleavable linking group is cleaved by enzymes such as peptidases and proteases in cells. Peptide-based cleavable linking groups are peptide bonds formed between amino acids to yield oligopeptides (e.g., dipeptides, tripeptides etc.) and polypeptides. Peptide-based cleavable groups do not include the amide group (—C(O)NH—). The amide group can be formed between any alkylene, alkenylene or alkynelene. A peptide bond is a special type of amide bond formed between amino acids to yield peptides and proteins. The peptide based cleavage group is generally limited to the peptide bond (i.e., the amide bond) formed between amino acids yielding peptides and proteins and does not include the entire amide functional group. Peptide-based cleavable linking groups have the general formula —NHCHRAC(O)NHCHRBC(O)—, where RA and RB are the R groups of the two adjacent amino acids. These candidates can be evaluated using methods analogous to those described above.

In some embodiments, an iRNA of the invention is conjugated to a carbohydrate through a linker. Non-limiting examples of iRNA carbohydrate conjugates with linkers of the compositions and methods of the invention include, but are not limited to,

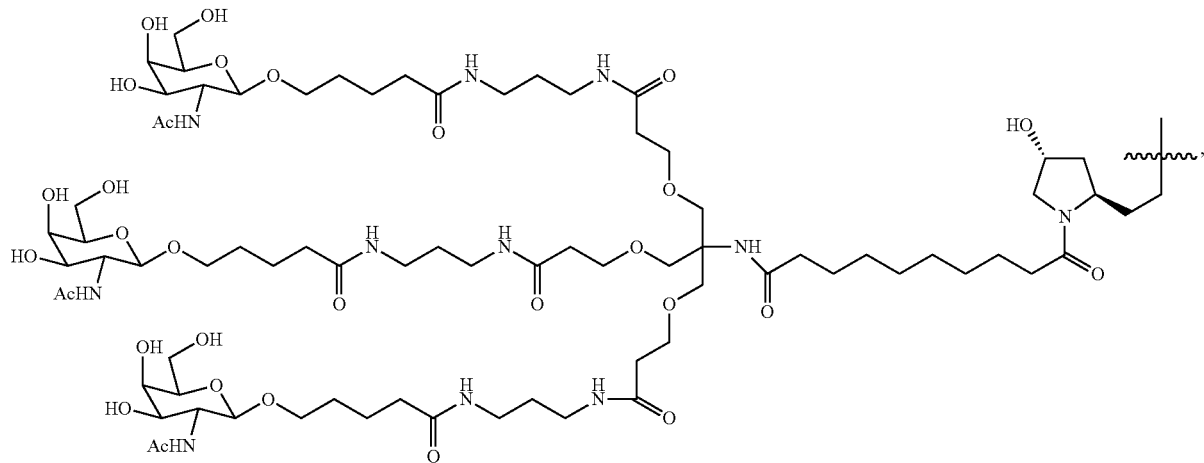
(Formula XXIV)
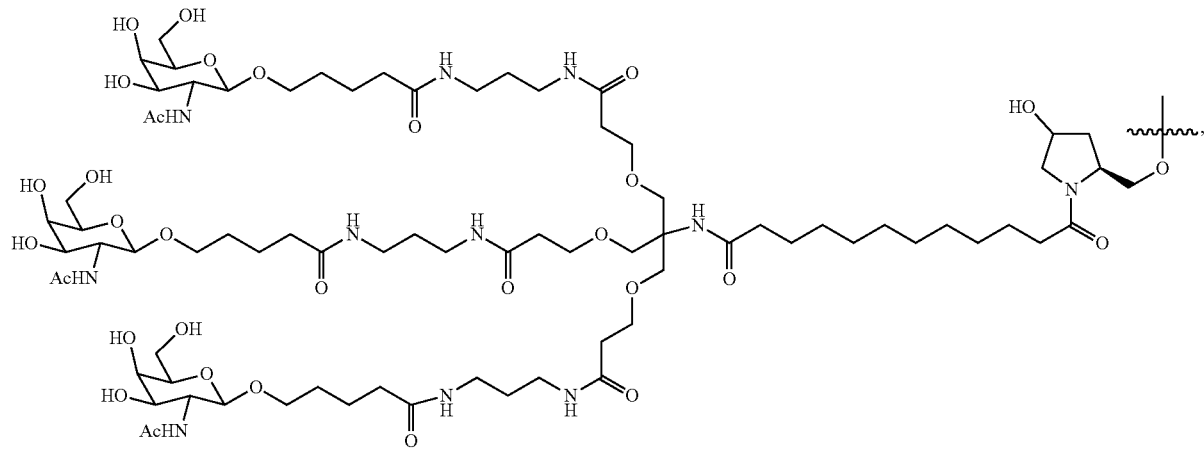
(Formula XXV)
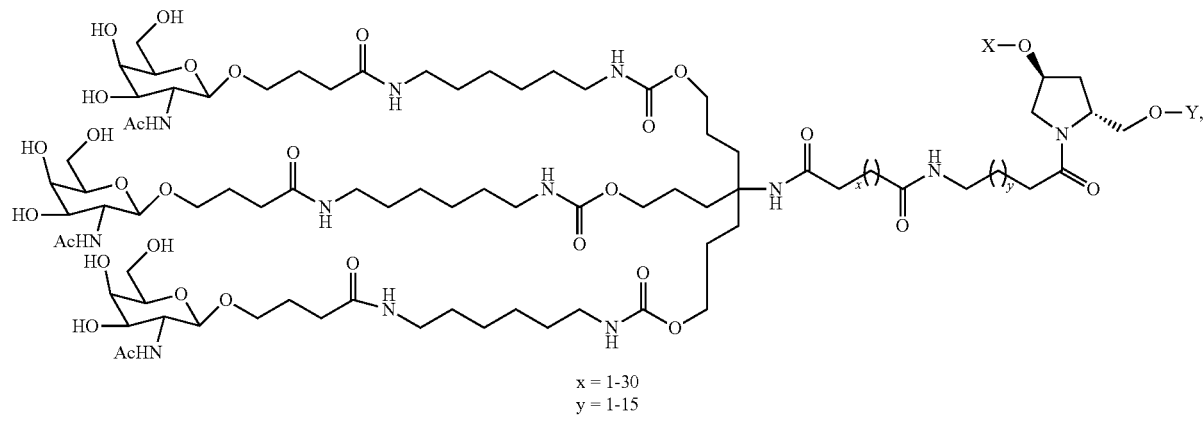
(Formula XXVI)
x = 1-30
y = 1-15

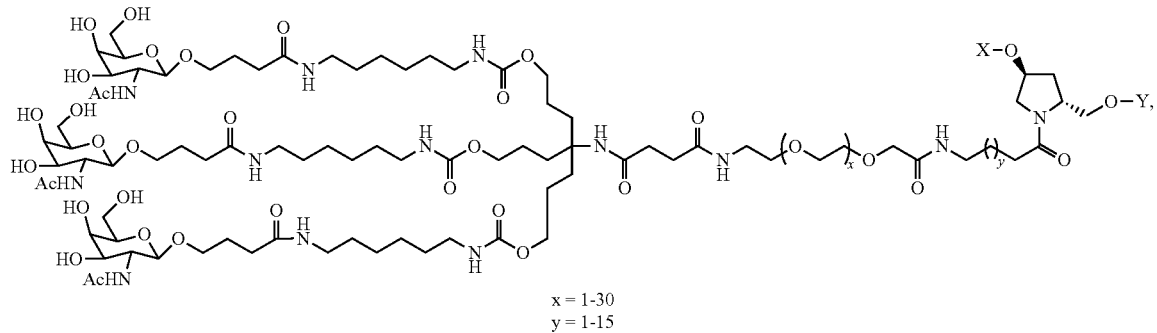
(Formula XXVII)
x = 1-30
y = 1-15
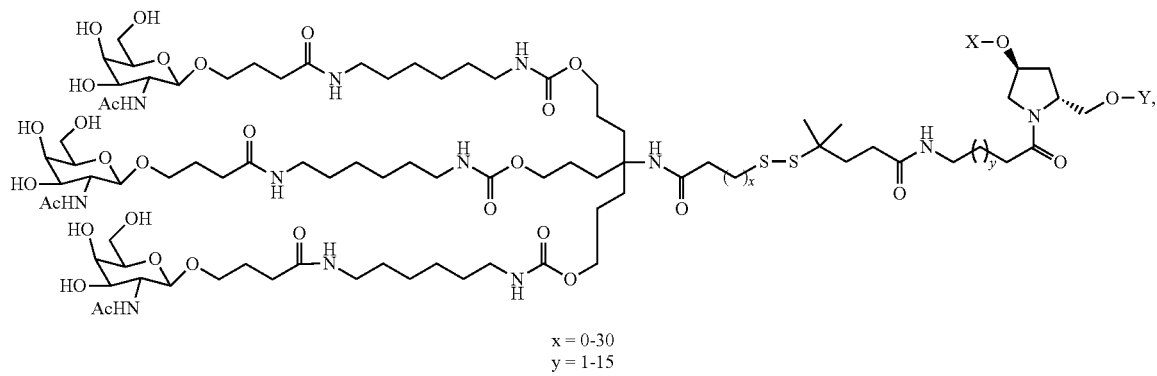
(Formula XXVIII)
x = 0-30
y = 1-15
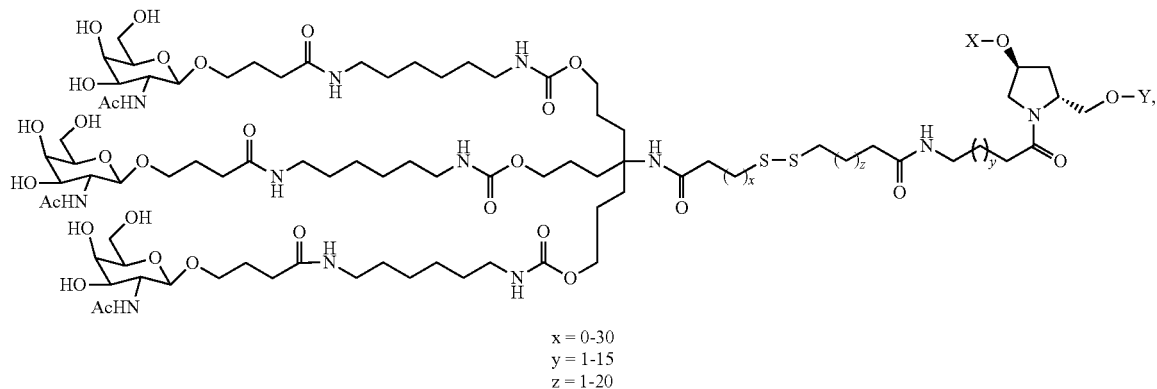
(Formula XXIX)
x = 0-30
y = 1-15
z = 1-20
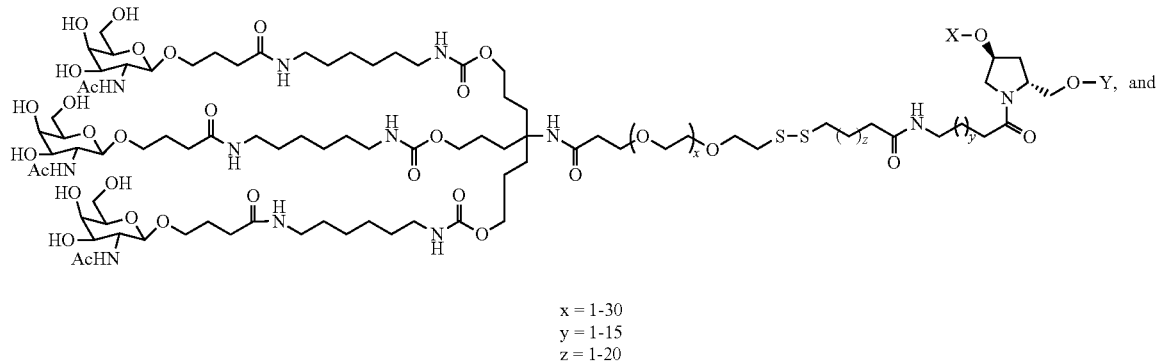
(Formula XXX) and
x = 1-30
y = 1-15
z = 1-20

(Formula XXXI)

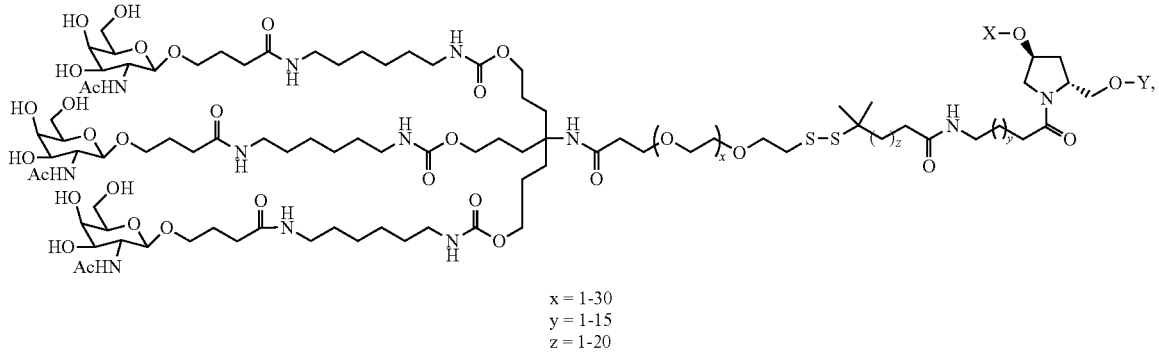

x = 1-30
y = 1-15
z = 1-20 when one of X or Y is an oligonucleotide, the other is a hydrogen.

In certain embodiments of the compositions and methods of the invention, a ligand is one or more "GalNAc" (N-acetylgalactosamine) derivatives attached through a bivalent or trivalent branched linker.

In certain embodiments, a dsRNA of the invention is conjugated to a bivalent or trivalent branched linker selected from the group of structures shown in any of formula (XXXII)-(XXXV):

Formula XXXII
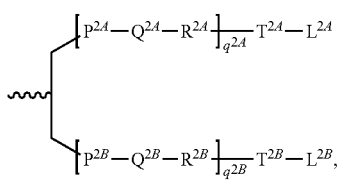

Formula XXXIII
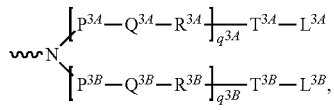

Formula XXXIV
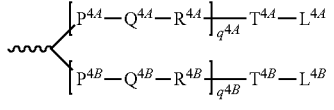

Formula XXXV
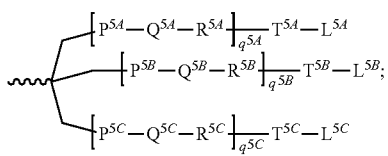

wherein:
q2A, q2B, q3A, q3B, q4A, q4B, q5A, q5B and q5C represent independently for each occurrence 0-20 and wherein the repeating unit can be the same or different;

$P^{2A}$, $P^{2B}$, $P^{3A}$, $P^{3B}$, $P^{4A}$, $P^{4B}$, $P^{5A}$, $P^{5B}$, $P^{5C}$, $T^{2A}$, $T^{2B}$, $T^{3A}$, $T^{3B}$, $T^{4A}$, $T^{4B}$, $T^{4A}$, $T^{5B}$, $T^{5C}$ are each independently for each occurrence absent, CO, NH, O, S, OC(O), NHC(O), $CH_2$, $CH_2NH$, or $CH_2O$;

$Q^{2A}$, $Q^{2B}$, $Q^{3A}$, $Q^{3B}$, $Q^{4A}$, $Q^{4B}$, $Q^{5A}$, $Q^{5B}$, $Q^{5C}$ are independently for each occurrence absent, alkylene, substituted alkylene wherein one or more methylenes can be interrupted or terminated by one or more of O, S, S(O), $SO_2$, $N(R^N)$, C(R')=C(R''), C≡C, or C(O);

$R^{2A}$, $R^{2B}$, $R^{3A}$, $R^{3B}$, $R^{4A}$, $R^{4B}$, $R^{5A}$, $R^{5B}$, $R^{5C}$ are each independently for each occurrence absent, NH, O, S, $CH_2$, C(O)O, C(O)NH, $NHCH(R^a)C(O)$, —C(O)—$CH(R^a)$—NH—, CO, CH=N—O,

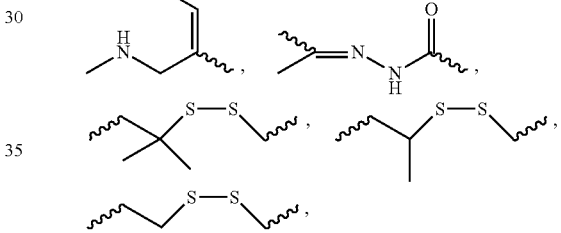

or heterocyclyl;
$L^{2A}$, $L^{2B}$, $L^{3A}$, $L^{3B}$, $L^{4A}$, $L^{4B}$, $L^{5A}$, $L^{5B}$, and $L^{5C}$ represent the ligand; i.e. each independently for each occurrence a monosaccharide (such as GalNAc), disaccharide, trisaccharide, tetrasaccharide, oligosaccharide, or polysaccharide; and $R^a$ is H or amino acid side chain. Trivalent conjugating GalNAc derivatives are particularly useful for use with RNAi agents for inhibiting the expression of a target gene, such as those of formula (XXXV):

Formula XXXV
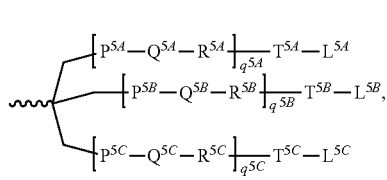

wherein $L^{5A}$, $L^{5B}$ and $L^{5C}$ represent a monosaccharide, such as GalNAc derivative.

Examples of suitable bivalent and trivalent branched linker groups conjugating GalNAc derivatives include, but are not limited to, the structures recited above as formulas II, VII, XI, X, and XIII.

Representative US patents that teach the preparation of RNA conjugates include, but are not limited to, U.S. Pat. Nos. 4,828,979; 4,948,882; 5,218,105; 5,525,465; 5,541, 313; 5,545,730; 5,552,538; 5,578,717, 5,580,731; 5,591, 584; 5,109,124; 5,118,802; 5,138,045; 5,414,077; 5,486, 603; 5,512,439; 5,578,718; 5,608,046; 4,587,044; 4,605, 735; 4,667,025; 4,762,779; 4,789,737; 4,824,941; 4,835, 263; 4,876,335; 4,904,582; 4,958,013; 5,082,830; 5,112, 963; 5,214,136; 5,082,830; 5,112,963; 5,214,136; 5,245, 022; 5,254,469; 5,258,506; 5,262,536; 5,272,250; 5,292, 873; 5,317,098; 5,371,241, 5,391,723; 5,416,203, 5,451, 463; 5,510,475; 5,512,667; 5,514,785; 5,565,552; 5,567, 810; 5,574,142; 5,585,481; 5,587,371; 5,595,726; 5,597, 696; 5,599,923; 5,599,928; 5,688,941; 6,294,664; 6,320, 017; 6,576,752; 6,783,931; 6,900,297; 7,037,646; and 8,106,022, the entire contents of each of which are hereby incorporated herein by reference.

It is not necessary for all positions in a given compound to be uniformly modified, and in fact more than one of the aforementioned modifications can be incorporated in a single compound or even at a single nucleoside within an iRNA. The present invention also includes iRNA compounds that are chimeric compounds.

"Chimeric" iRNA compounds or "chimeras," in the context of this invention, are iRNA compounds, preferably dsRNAi agents, that contain two or more chemically distinct regions, each made up of at least one monomer unit, i.e., a nucleotide in the case of a dsRNA compound. These iRNAs typically contain at least one region wherein the RNA is modified so as to confer upon the iRNA increased resistance to nuclease degradation, increased cellular uptake, or increased binding affinity for the target nucleic acid. An additional region of the iRNA can serve as a substrate for enzymes capable of cleaving RNA:DNA or RNA:RNA hybrids. By way of example, RNase H is a cellular endonuclease which cleaves the RNA strand of an RNA:DNA duplex. Activation of RNase H, therefore, results in cleavage of the RNA target, thereby greatly enhancing the efficiency of iRNA inhibition of gene expression. Consequently, comparable results can often be obtained with shorter iRNAs when chimeric dsRNAs are used, compared to phosphorothioate deoxy dsRNAs hybridizing to the same target region. Cleavage of the RNA target can be routinely detected by gel electrophoresis and, if necessary, associated nucleic acid hybridization techniques known in the art.

In certain instances, the RNA of an iRNA can be modified by a non-ligand group. A number of non-ligand molecules have been conjugated to iRNAs in order to enhance the activity, cellular distribution or cellular uptake of the iRNA, and procedures for performing such conjugations are available in the scientific literature. Such non-ligand moieties have included lipid moieties, such as cholesterol (Kubo, T. et al., *Biochem. Biophys. Res. Comm.*, 2007, 365(1):54-61; Letsinger et al., *Proc. Natl. Acad. Sci. USA*, 1989, 86:6553), cholic acid (Manoharan et al., *Bioorg. Med. Chem. Lett.*, 1994, 4:1053), a thioether, e.g., hexyl-S-tritylthiol (Manoharan et al., *Ann. N.Y. Acad. Sci.*, 1992, 660:306; Manoharan et al., *Bioorg. Med. Chem. Let.*, 1993, 3:2765), a thiocholesterol (Oberhauser et al., *Nucl. Acids Res.*, 1992, 20:533), an aliphatic chain, e.g., dodecandiol or undecyl residues (Saison-Behmoaras et al., *EMBO J.*, 1991, 10:111; Kabanov et al., *FEBS Lett.*, 1990, 259:327; Svinarchuk et al., *Biochimie*, 1993, 75:49), a phospholipid, e.g., di-hexadecyl-rac-glycerol or triethylammonium 1,2-di-O-hexadecyl-rac-glycero-3-H-phosphonate (Manoharan et al., *Tetrahedron Lett.*, 1995, 36:3651; Shea et al., *Nucl. Acids Res.*, 1990, 18:3777), a polyamine or a polyethylene glycol chain (Manoharan et al., *Nucleosides & Nucleotides*, 1995, 14:969), or adamantane acetic acid (Manoharan et al., *Tetrahedron Lett.*, 1995, 36:3651), a palmityl moiety (Mishra et al., *Biochim. Biophys. Acta*, 1995, 1264:229), or an octadecylamine or hexylamino-carbonyl-oxycholesterol moiety (Crooke et al., *J. Pharmacol. Exp. Ther.*, 1996, 277:923). Representative United States patents that teach the preparation of such RNA conjugates have been listed above. Typical conjugation protocols involve the synthesis of RNAs bearing an aminolinker at one or more positions of the sequence. The amino group is then reacted with the molecule being conjugated using appropriate coupling or activating reagents. The conjugation reaction can be performed either with the RNA still bound to the solid support or following cleavage of the RNA, in solution phase. Purification of the RNA conjugate by HPLC typically affords the pure conjugate.

IV. Delivery of an iRNA of the Invention

The delivery of an iRNA of the invention to a cell e.g., a cell within a subject, such as a human subject (e.g., a subject in need thereof, such as a subject having a disease, disorder, or condition associated with XDH gene expression) can be achieved in a number of different ways. For example, delivery may be performed by contacting a cell with an iRNA of the invention either in vitro or in vivo. In vivo delivery may also be performed directly by administering a composition comprising an iRNA, e.g., a dsRNA, to a subject. Alternatively, in vivo delivery may be performed indirectly by administering one or more vectors that encode and direct the expression of the iRNA. These alternatives are discussed further below.

In general, any method of delivering a nucleic acid molecule (in vitro or in vivo) can be adapted for use with an iRNA of the invention (see e.g., Akhtar S and Julian R L. (1992) *Trends Cell. Biol.* 2(5):139-144 and WO94/02595, which are incorporated herein by reference in their entireties). For in vivo delivery, factors to consider in order to deliver an iRNA molecule include, for example, biological stability of the delivered molecule, prevention of non-specific effects, and accumulation of the delivered molecule in the target tissue. The non-specific effects of an iRNA can be minimized by local administration, for example, by direct injection or implantation into a tissue or topically administering the preparation. Local administration to a treatment site maximizes local concentration of the agent, limits the exposure of the agent to systemic tissues that can otherwise be harmed by the agent or that can degrade the agent, and permits a lower total dose of the iRNA molecule to be administered. Several studies have shown successful knockdown of gene products when a dsRNAi agent is administered locally. For example, intraocular delivery of a VEGF dsRNA by intravitreal injection in cynomolgus monkeys (Tolentino, M J, et al (2004) *Retina* 24:132-138) and sub-retinal injections in mice (Reich, S J., et al (2003) *Mol. Vis.* 9:210-216) were both shown to prevent neovascularization in an experimental model of age-related macular degeneration. In addition, direct intratumoral injection of a dsRNA in mice reduces tumor volume (Pille, J., et al (2005) *Mol. Ther.* 11:267-274) and can prolong survival of tumor-bearing mice (Kim, W J., et al (2006) *Mol. Ther.* 14:343-350; Li, S., et al (2007) *Mol. Ther.* 15:515-523). RNA interference has also shown success with local delivery to the CNS by direct injection (Dorn, G., et al. (2004) *Nucleic Acids* 32:e49; Tan, P H., et al (2005) *Gene Ther.* 12:59-66; Makimura, H., et al (2002) *BMC Neurosci.* 3:18; Shishkina, G T., et al (2004) *Neuroscience* 129:521-528; Thakker, E R., et al (2004) *Proc. Natl. Acad. Sci. U.S.A.* 101:17270-17275; Akaneya,Y., et al (2005) *J. Neurophysiol.* 93:594-602) and to the lungs by intranasal administration (Howard, K A., et al (2006) *Mol. Ther.* 14:476-484; Zhang, X., et al (2004) *J. Biol. Chem.* 279:10677-10684; Bitko, V., et al (2005) *Nat. Med.* 11:50-55). For administering an iRNA systemically for the treatment of a disease, the RNA can be modified or alternatively delivered using a drug delivery system; both methods act to prevent the rapid degradation of the dsRNA by endo- and exo-nucleases in vivo. Modification of the RNA or the pharmaceutical carrier can also permit targeting of the iRNA to the target tissue and avoid undesirable off-target effects. iRNA molecules can be modified by chemical conjugation to lipophilic groups such as cholesterol to enhance cellular uptake and prevent degradation. For example, an iRNA directed against ApoB conjugated to a lipophilic cholesterol moiety was injected systemically into mice and resulted in knockdown of apoB mRNA in both the liver and jejunum (Soutschek, J., et al (2004) *Nature* 432:173-178). Conjugation of an iRNA to an aptamer has been shown to inhibit tumor growth and mediate tumor regression in a mouse model of prostate cancer (McNamara, J O, et al (2006) *Nat. Biotechnol.* 24:1005-1015). In an alternative embodiment, the iRNA can be delivered using drug delivery systems such as a nanoparticle, a dendrimer, a polymer, liposomes, or a cationic delivery system. Positively charged cationic delivery systems facilitate binding of an iRNA molecule (negatively charged) and also enhance interactions at the negatively charged cell membrane to permit efficient uptake of an iRNA by the cell. Cationic lipids, dendrimers, or polymers can either be bound to an iRNA, or induced to form a vesicle or micelle (see e.g., Kim S H, et al (2008) *Journal of Controlled Release* 129(2):107-116) that encases an iRNA. The formation of vesicles or micelles further prevents degradation of the iRNA when administered systemically. Methods for making and administering cationic-iRNA complexes are well within the abilities of one skilled in the art (see e.g., Sorensen, D R, et al (2003) *J. Mol. Biol* 327:761-766; Verma, U N, et al (2003) *Clin. Cancer Res.* 9:1291-1300; Arnold, A S et al (2007) *J. Hypertens.* 25:197-205, which are incorporated herein by reference in their entirety). Some non-limiting examples of drug delivery systems useful for systemic delivery of iRNAs include DOTAP (Sorensen, D R., et al (2003), supra; Verma, U N, et al (2003), supra), Oligofectamine, "solid nucleic acid lipid particles" (Zimmermann, T S, et al (2006) *Nature* 441:111-114), cardiolipin (Chien, P Y, et al (2005) *Cancer Gene Ther.* 12:321-328; Pal, A, et al (2005) *Int J. Oncol.* 26:1087-1091), polyethyleneimine (Bonnet M E, et al (2008) *Pharm. Res.* August 16 Epub ahead of print; Aigner, A. (2006) *J. Biomed. Biotechnol.* 71659), Arg-Gly-Asp (RGD) peptides (Liu, S. (2006) *Mol. Pharm.* 3:472-487), and polyamidoamines (Tomalia, D A, et al (2007) *Biochem. Soc. Trans.* 35:61-67; Yoo, H., et al (1999) *Pharm. Res.* 16:1799-1804). In some embodiments, an iRNA forms a complex with cyclodextrin for systemic administration. Methods for administration and pharmaceutical compositions of iRNAs and cyclodextrins can be found in U.S. Pat. No. 7,427,605, which is herein incorporated by reference in its entirety.

A. Vector Encoded iRNAs of the Invention iRNA targeting the XDH gene can be expressed from transcription units inserted into DNA or RNA vectors (see, e.g., Couture, A, et al., *TIG.* (1996), 12:5-10; Skillern, A, et al., International PCT Publication No. WO 00/22113, Conrad, International PCT Publication No. WO 00/22114, and Conrad, U.S. Pat. No. 6,054,299). Expression can be transient (on the order of hours to weeks) or sustained (weeks to months or longer), depending upon the specific construct used and the target tissue or cell type. These transgenes can be introduced as a linear construct, a circular plasmid, or a viral vector, which can be an integrating or non-integrating vector. The transgene can also be constructed to permit it to be inherited as an extrachromosomal plasmid (Gassmann, et al., *Proc. Natl. Acad. Sci. USA* (1995) 92:1292).

The individual strand or strands of an iRNA can be transcribed from a promoter on an expression vector. Where two separate strands are to be expressed to generate, for example, a dsRNA, two separate expression vectors can be co-introduced (e.g., by transfection or infection) into a target cell. Alternatively each individual strand of a dsRNA can be transcribed by promoters both of which are located on the same expression plasmid. In one embodiment, a dsRNA is expressed as inverted repeat polynucleotides joined by a linker polynucleotide sequence such that the dsRNA has a stem and loop structure.

iRNA expression vectors are generally DNA plasmids or viral vectors. Expression vectors compatible with eukaryotic cells, preferably those compatible with vertebrate cells, can be used to produce recombinant constructs for the expression of an iRNA as described herein. Eukaryotic cell expression vectors are well known in the art and are available from a number of commercial sources. Typically, such vectors are provided containing convenient restriction sites for insertion of the desired nucleic acid segment. Delivery of iRNA expressing vectors can be systemic, such as by intravenous or intramuscular administration, by administration to target cells ex-planted from the patient followed by reintroduction into the patient, or by any other means that allows for introduction into a desired target cell.

Viral vector systems which can be utilized with the methods and compositions described herein include, but are not limited to, (a) adenovirus vectors; (b) retrovirus vectors, including but not limited to lentiviral vectors, moloney murine leukemia virus, etc.; (c) adeno-associated virus vectors; (d) herpes simplex virus vectors; (e) SV 40 vectors; (f) polyoma virus vectors; (g) papilloma virus vectors; (h) picornavirus vectors; (i) pox virus vectors such as an orthopox, e.g., vaccinia virus vectors or avipox, e.g. canary pox or fowl pox; and (j) a helper-dependent or gutless adenovirus. Replication-defective viruses can also be advantageous. Different vectors will or will not become incorporated into the cells' genome. The constructs can include viral sequences for transfection, if desired. Alternatively, the construct can be incorporated into vectors capable of episomal replication, e.g. EPV and EBV vectors. Constructs for the recombinant expression of an iRNA will generally require regulatory elements, e.g., promoters, enhancers, etc., to ensure the expression of the iRNA in target cells. Other aspects to consider for vectors and constructs are known in the art.

V. Pharmaceutical Compositions of the Invention

The present invention also includes pharmaceutical compositions and formulations which include the iRNAs of the invention. In one embodiment, provided herein are pharmaceutical compositions containing an iRNA, as described herein, and a pharmaceutically acceptable carrier. The pharmaceutical compositions containing the iRNA are useful for treating a disease or disorder associated with the expression or activity of an XDH gene. Such pharmaceutical compositions are formulated based on the mode of delivery. One example is compositions that are formulated for systemic administration via parenteral delivery, e.g., by subcutaneous (SC), intramuscular (IM), or intravenous (IV) delivery. The pharmaceutical compositions of the invention may be administered in dosages sufficient to inhibit expression of an XDH gene.

The pharmaceutical compositions of the invention may be administered in dosages sufficient to inhibit expression of an XDH gene. In general, a suitable dose of an iRNA of the invention will be in the range of about 0.001 to about 200.0 milligrams per kilogram body weight of the recipient per day, generally in the range of about 1 to 50 mg per kilogram body weight per day. Typically, a suitable dose of an iRNA of the invention will be in the range of about 0.1 mg/kg to about 5.0 mg/kg, preferably about 0.3 mg/kg and about 3.0 mg/kg. A repeat-dose regimine may include administration of a therapeutic amount of iRNA on a regular basis, such as every other day or once a year. In certain embodiments, the iRNA is administered about once per month to about once per quarter (i.e., about once every three months).

After an initial treatment regimen, the treatments can be administered on a less frequent basis. For example, after administration weekly or biweekly for three months, administration can be repeated once per month, for six months, or a year; or longer.

The pharmaceutical composition can be administered once daily, or the iRNA can be administered as two, three, or more sub-doses at appropriate intervals throughout the day or even using continuous infusion or delivery through a controlled release formulation. In that case, the iRNA contained in each sub-dose must be correspondingly smaller in order to achieve the total daily dosage. The dosage unit can also be compounded for delivery over several days, e.g., using a conventional sustained release formulation which provides sustained release of the iRNA over a several day period. Sustained release formulations are well known in the art and are particularly useful for delivery of agents at a particular site, such as could be used with the agents of the present invention. In this embodiment, the dosage unit contains a corresponding multiple of the daily dose.

In other embodiments, a single dose of the pharmaceutical compositions can be long lasting, such that subsequent doses are administered at not more than 3, 4, or 5 day intervals, or at not more than 1, 2, 3, or 4 week intervals. In some embodiments of the invention, a single dose of the pharmaceutical compositions of the invention is administered once per week. In other embodiments of the invention, a single dose of the pharmaceutical compositions of the invention is administered bi-monthly.

The skilled artisan will appreciate that certain factors can influence the dosage and timing required to effectively treat a subject, including but not limited to the severity of the disease or disorder, previous treatments, the general health or age of the subject, and other diseases present. Moreover, treatment of a subject with a therapeutically effective amount of a composition can include a single treatment or a series of treatments. Estimates of effective dosages and in vivo half-lives for the individual iRNAs encompassed by the invention can be made using conventional methodologies or on the basis of in vivo testing using an appropriate animal model, as known in the art. For example, both genetic and induced models of hyperuricemia are known in the art. Genetic models of hyperuricemia include the B6; 129S7-Uox$^{tm1Bay}$/J mouse available from Jackson Laboratory (/jaxmice.jax.org/strain/002223.html) which develops hyperuricemia, with 10-fold higher levels of serum uric acid levels. Alternatively, hyperuricemia can be included in rats by feeing with a uricase inhibitor (oxonic acid) in the diet (Mazzali et al., Hypertension 38:1101-1106, 2001; Habu et al., Biochem. Pharmacol. 66:1107-1114, 2003). Unlike humans, rats and mice have uricase which metabolises uric acid, therefore, the enzyme must be inhibited in small animal models. Such models and considerations are well known in the art.

The pharmaceutical compositions of the present invention can be administered in a number of ways depending upon whether local or systemic treatment is desired and upon the area to be treated. Administration can be topical (e.g., by a transdermal patch), pulmonary, e.g., by inhalation or insufflation of powders or aerosols, including by nebulizer; intratracheal, intranasal, epidermal and transdermal, oral or parenteral. Parenteral administration includes intravenous, intraarterial, subcutaneous, intraperitoneal, or intramuscular injection or infusion; subdermal, e.g., via an implanted device; or intracranial, e.g., by intraparenchymal, intrathecal or intraventricular administration.

The iRNA can be delivered in a manner to target a particular tissue (e.g., vascular endothelial cells).

Pharmaceutical compositions and formulations for topical or transdermal administration can include transdermal patches, ointments, lotions, creams, gels, drops, suppositories, sprays, liquids and powders. Conventional pharmaceutical carriers, aqueous, powder or oily bases, thickeners and the like can be necessary or desirable. Coated condoms, gloves and the like can also be useful. Suitable topical formulations include those in which the iRNAs featured in the invention are in admixture with a topical delivery agent such as lipids, liposomes, fatty acids, fatty acid esters, steroids, chelating agents and surfactants. Suitable lipids and liposomes include neutral (e.g., dioleoylphosphatidyl DOPE ethanolamine, dimyristoylphosphatidyl choline DMPC, distearolyphosphatidyl choline) negative (e.g., dimyristoylphosphatidyl glycerol DMPG) and cationic (e.g., dioleoyltetramethylaminopropyl DOTAP and dioleoylphosphatidyl ethanolamine DOTMA). iRNAs featured in the invention can be encapsulated within liposomes or can form complexes thereto, in particular to cationic liposomes. Alternatively, iRNAs can be complexed to lipids, in particular to cationic lipids. Suitable fatty acids and esters include but are not limited to arachidonic acid, oleic acid, eicosanoic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a $C_{1-20}$ alkyl ester (e.g., isopropylmyristate IPM), monoglyceride, diglyceride or pharmaceutically acceptable salt thereof). Topical formulations are described in detail in U.S. Pat. No. 6,747,014, which is incorporated herein by reference.

A. iRNA Formulations Comprising Membranous Molecular Assemblies

An iRNA for use in the compositions and methods of the invention can be formulated for delivery in a membranous molecular assembly, e.g., a liposome or a micelle. As used herein, the term "liposome" refers to a vesicle composed of amphiphilic lipids arranged in at least one bilayer, e.g., one bilayer or a plurality of bilayers. Liposomes include unilamellar and multilamellar vesicles that have a membrane formed from a lipophilic material and an aqueous interior. The aqueous portion contains the iRNA. The lipophilic material isolates the aqueous interior from an aqueous exterior, which typically does not include the iRNA composition, although in some examples, it may. Liposomes are useful for the transfer and delivery of active ingredients to the site of action. Because the liposomal membrane is structurally similar to biological membranes, when liposomes are applied to a tissue, the liposomal bilayer fuses with bilayer of the cellular membranes. As the merging of the liposome and cell progresses, the internal aqueous contents that include the iRNA are delivered into the cell where the iRNA can specifically bind to a target RNA and can mediate RNA interference. In some cases the liposomes are also specifically targeted, e.g., to direct the iRNA to particular cell types.

A liposome containing an iRNA agent can be prepared by a variety of methods. In one example, the lipid component of a liposome is dissolved in a detergent so that micelles are formed with the lipid component. For example, the lipid component can be an amphipathic cationic lipid or lipid conjugate. The detergent can have a high critical micelle concentration and may be nonionic. Exemplary detergents include cholate, CHAPS, octylglucoside, deoxycholate, and lauroyl sarcosine. The iRNA agent preparation is then added to the micelles that include the lipid component. The cationic groups on the lipid interact with the iRNA agent and condense around the iRNA agent to form a liposome. After condensation, the detergent is removed, e.g., by dialysis, to yield a liposomal preparation of iRNA agent.

If necessary a carrier compound that assists in condensation can be added during the condensation reaction, e.g., by controlled addition. For example, the carrier compound can be a polymer other than a nucleic acid (e.g., spermine or spermidine). pH can also adjusted to favor condensation.

Methods for producing stable polynucleotide delivery vehicles, which incorporate a polynucleotide/cationic lipid complex as structural components of the delivery vehicle, are further described in, e.g., WO 96/37194, the entire contents of which are incorporated herein by reference. Liposome formation can also include one or more aspects of exemplary methods described in Feigner, P. L. et al., *Proc. Natl. Acad. Sci., USA* 8:7413-7417, 1987; U.S. Pat. Nos. 4,897,355; 5,171,678; Bangham, et al. *M. Mol. Biol.* 23:238, 1965; Olson, et al. *Biochim. Biophys. Acta* 557:9, 1979; Szoka, et al. *Proc. Natl. Acad. Sci.* 75: 4194, 1978; Mayhew, et al. *Biochim. Biophys. Acta* 775:169, 1984; Kim, et al. *Biochim. Biophys. Acta* 728:339, 1983; and Fukunaga, et al. *Endocrinol.* 115:757, 1984. Commonly used techniques for preparing lipid aggregates of appropriate size for use as delivery vehicles include sonication and freeze-thaw plus extrusion (see, e.g., Mayer, et al. *Biochim. Biophys. Acta* 858:161, 1986). Microfluidization can be used when consistently small (50 to 200 nm) and relatively uniform aggregates are desired (Mayhew, et al. *Biochim. Biophys. Acta* 775:169, 1984). These methods are readily adapted to packaging iRNA agent preparations into liposomes.

Liposomes fall into two broad classes. Cationic liposomes are positively charged liposomes which interact with the negatively charged nucleic acid molecules to form a stable complex. The positively charged nucleic acid/liposome complex binds to the negatively charged cell surface and is internalized in an endosome. Due to the acidic pH within the endosome, the liposomes are ruptured, releasing their contents into the cell cytoplasm (Wang et al., *Biochem. Biophys. Res. Commun.*, 1987, 147, 980-985).

Liposomes which are pH-sensitive or negatively-charged, entrap nucleic acids rather than complex with it. Since both the nucleic acid and the lipid are similarly charged, repulsion rather than complex formation occurs. Nevertheless, some nucleic acid is entrapped within the aqueous interior of these liposomes. pH-sensitive liposomes have been used to deliver nucleic acids encoding the thymidine kinase gene to cell monolayers in culture. Expression of the exogenous gene was detected in the target cells (Zhou et al., *Journal of Controlled Release*, 1992, 19, 269-274).

One major type of liposomal composition includes phospholipids other than naturally-derived phosphatidylcholine. Neutral liposome compositions, for example, can be formed from dimyristoyl phosphatidylcholine (DMPC) or dipalmitoyl phosphatidylcholine (DPPC). Anionic liposome compositions generally are formed from dimyristoyl phosphatidylglycerol, while anionic fusogenic liposomes are formed primarily from dioleoyl phosphatidylethanolamine (DOPE). Another type of liposomal composition is formed from phosphatidylcholine (PC) such as, for example, soybean PC, and egg PC. Another type is formed from mixtures of two or more of phospholipid, phosphatidylcholine, and cholesterol.

Examples of other methods to introduce liposomes into cells in vitro and in vivo include U.S. Pat. Nos. 5,283,185 and 5,171,678; WO 94/00569; WO 93/24640; WO 91/16024; Feigner, *J. Biol. Chem.* 269:2550, 1994; Nabel, *Proc. Natl. Acad. Sci.* 90:11307, 1993; Nabel, *Human Gene Ther.* 3:649, 1992; Gershon, *Biochem.* 32:7143, 1993; and Strauss *EMBO J.* 11:417, 1992.

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver cyclosporin-A into the dermis of mouse skin. Results indicated that such non-ionic liposomal systems were effective in facilitating the deposition of cyclosporine A into different layers of the skin (Hu et al. *S.T.P. Pharma. Sci.*, 1994, 4(6) 466).

Liposomes also include "sterically stabilized" liposomes, a term which, as used herein, refers to liposomes comprising one or more specialized lipids that, when incorporated into liposomes, result in enhanced circulation lifetimes relative to liposomes lacking such specialized lipids. Examples of sterically stabilized liposomes are those in which part of the vesicle-forming lipid portion of the liposome (A) comprises one or more glycolipids, such as monosialoganglioside $G_{M1}$, or (B) is derivatized with one or more hydrophilic polymers, such as a polyethylene glycol (PEG) moiety. While not wishing to be bound by any particular theory, it is thought in the art that, at least for sterically stabilized liposomes containing gangliosides, sphingomyelin, or PEG-derivatized lipids, the enhanced circulation half-life of these sterically stabilized liposomes derives from a reduced uptake into cells of the reticuloendothelial system (RES) (Allen et al., *FEBS Letters,* 1987, 223, 42; Wu et al., *Cancer Research,* 1993, 53, 3765).

Various liposomes comprising one or more glycolipids are known in the art. Papahadjopoulos et al. (*Ann. N.Y. Acad. Sci.,* 1987, 507, 64) reported the ability of monosialoganglioside $G_{M1}$, galactocerebroside sulfate and phosphatidylinositol to improve blood half-lives of liposomes. These findings were expounded upon by Gabizon et al. (*Proc. Natl. Acad. Sci. U.S.A.,* 1988, 85, 6949). U.S. Pat. No. 4,837,028 and WO 88/04924, both to Allen et al., disclose liposomes comprising (1) sphingomyelin and (2) the ganglioside $G_{M1}$ or a galactocerebroside sulfate ester. U.S. Pat. No. 5,543,152 (Webb et al.) discloses liposomes comprising sphingomyelin. Liposomes comprising 1,2-sn-dimyristoylphosphatidylcholine are disclosed in WO 97/13499 (Lim et al).

In some embodiments, cationic liposomes are used. Cationic liposomes possess the advantage of being able to fuse to the cell membrane. Non-cationic liposomes, although not able to fuse as efficiently with the plasma membrane, are taken up by macrophages in vivo and can be used to deliver iRNA agents to macrophages.

Further advantages of liposomes include: liposomes obtained from natural phospholipids are biocompatible and biodegradable; liposomes can incorporate a wide range of water and lipid soluble drugs; liposomes can protect encapsulated iRNAs in their internal compartments from metabolism and degradation (Rosoff, in "Pharmaceutical Dosage Forms," Lieberman, Rieger and Banker (Eds.), 1988, volume 1, p. 245). Important considerations in the preparation of liposome formulations are the lipid surface charge, vesicle size, and the aqueous volume of the liposomes.

A positively charged synthetic cationic lipid, N-[1-(2,3-dioleyloxy)propyl]-N,N,N-trimethylammonium chloride (DOTMA) can be used to form small liposomes that interact spontaneously with nucleic acid to form lipid-nucleic acid complexes which are capable of fusing with the negatively charged lipids of the cell membranes of tissue culture cells, resulting in delivery of iRNA agent (see, e.g., Feigner, P. L. et al., Proc. Natl. Acad. Sci., USA 8:7413-7417, 1987 and U.S. Pat. No. 4,897,355 for a description of DOTMA and its use with DNA).

A DOTMA analogue, 1,2-bis(oleoyloxy)-3-(trimethylammonia)propane (DOTAP) can be used in combination with a phospholipid to form DNA-complexing vesicles. Lipofectin™ (Bethesda Research Laboratories, Gaithersburg, Md.) is an effective agent for the delivery of highly anionic nucleic acids into living tissue culture cells that comprise positively charged DOTMA liposomes which interact spontaneously with negatively charged polynucleotides to form complexes. When enough positively charged liposomes are used, the net charge on the resulting complexes is also positive. Positively charged complexes prepared in this way spontaneously attach to negatively charged cell surfaces, fuse with the plasma membrane, and efficiently deliver functional nucleic acids into, for example, tissue culture cells. Another commercially available cationic lipid, 1,2-bis (oleoyloxy)-3,3-(trimethylammonia)propane ("DOTAP") (Boehringer Mannheim, Indianapolis, Ind.) differs from DOTMA in that the oleoyl moieties are linked by ester, rather than ether linkages.

Other reported cationic lipid compounds include those that have been conjugated to a variety of moieties including, for example, carboxyspermine which has been conjugated to one of two types of lipids and includes compounds such as 5-carboxyspermylglycine dioctaoleoylamide ("DOGS") (Transfectam™, Promega, Madison, Wis.) and dipalmitoylphosphatidylethanolamine 5-carboxyspermyl-amide ("DPPES") (see, e.g., U.S. Pat. No. 5,171,678).

Another cationic lipid conjugate includes derivatization of the lipid with cholesterol ("DC-Chol") which has been formulated into liposomes in combination with DOPE (See, Gao, X. and Huang, L., Biochim. Biophys. Res. Commun. 179:280, 1991). Lipopolylysine, made by conjugating polylysine to DOPE, has been reported to be effective for transfection in the presence of serum (Zhou, X. et al., Biochim. Biophys. Acta 1065:8, 1991). For certain cell lines, these liposomes containing conjugated cationic lipids, are said to exhibit lower toxicity and provide more efficient transfection than the DOTMA-containing compositions. Other commercially available cationic lipid products include DMRIE and DMRIE-HP (Vical, La Jolla, Calif.) and Lipofectamine (DOSPA) (Life Technology, Inc., Gaithersburg, Md.). Other cationic lipids suitable for the delivery of oligonucleotides are described in WO 98/39359 and WO 96/37194.

Liposomal formulations are particularly suited for topical administration, liposomes present several advantages over other formulations. Such advantages include reduced side effects related to high systemic absorption of the administered drug, increased accumulation of the administered drug at the desired target, and the ability to administer iRNA agent into the skin. In some implementations, liposomes are used for delivering iRNA agent to epidermal cells and also used to enhance the penetration of iRNA agent into dermal tissues, e.g., into skin. For example, the liposomes can be applied topically. Topical delivery of drugs formulated as liposomes to the skin has been documented (see, e.g., Weiner et al., *Journal of Drug Targeting*, 1992, vol. 2, 405-410 and du Plessis et al., *Antiviral Research*, 18, 1992, 259-265; Mannino, R. J. and Fould-Fogerite, S., *Biotechniques* 6:682-690, 1988; Itani, T. et al. *Gene* 56:267-276. 1987; Nicolau, C. et al. *Meth. Enz.* 149:157-176, 1987; Straubinger, R. M. and Papahadjopoulos, D. *Meth. Enz.* 101:512-527, 1983; Wang, C. Y. and Huang, L., *Proc. Natl. Acad. Sci. USA* 84:7851-7855, 1987).

Non-ionic liposomal systems have also been examined to determine their utility in the delivery of drugs to the skin, in particular systems comprising non-ionic surfactant and cholesterol. Non-ionic liposomal formulations comprising Novasome™ I (glyceryl dilaurate/cholesterol/polyoxyethylene-10-stearyl ether) and Novasome™ II (glyceryl distearate/cholesterol/polyoxyethylene-10-stearyl ether) were used to deliver a drug into the dermis of mouse skin. Such formulations with iRNA agent are useful for treating a dermatological disorder.

Liposomes that include iRNA can be made highly deformable. Such deformability can enable the liposomes to penetrate through pore that are smaller than the average radius of the liposome. For example, transfersomes are a type of deformable liposomes. Transferosomes can be made by adding surface edge activators, usually surfactants, to a standard liposomal composition. Transfersomes that include iRNAs can be delivered, for example, subcutaneously by infection in order to deliver iRNAs to keratinocytes in the skin. In order to cross intact mammalian skin, lipid vesicles must pass through a series of fine pores, each with a diameter less than 50 nm, under the influence of a suitable transdermal gradient. In addition, due to the lipid properties, these transferosomes can be self-optimizing (adaptive to the shape of pores, e.g., in the skin), self-repairing, and can frequently reach their targets without fragmenting, and often self-loading.

Other formulations amenable to the present invention are described in WO/2008/042973. Transfersomes are yet another type of liposomes, and are highly deformable lipid aggregates which are attractive candidates for drug delivery vehicles. Transfersomes can be described as lipid droplets which are so highly deformable that they are easily able to penetrate through pores which are smaller than the droplet. Transfersomes are adaptable to the environment in which they are used, e.g., they are self-optimizing (adaptive to the shape of pores in the skin), self-repairing, frequently reach their targets without fragmenting, and often self-loading. To make transfersomes it is possible to add surface edge-activators, usually surfactants, to a standard liposomal composition. Transfersomes have been used to deliver serum albumin to the skin. The transfersome-mediated delivery of serum albumin has been shown to be as effective as subcutaneous injection of a solution containing serum albumin.

Surfactants find wide application in formulations such as emulsions (including microemulsions) and liposomes. The most common way of classifying and ranking the properties of the many different types of surfactants, both natural and synthetic, is by the use of the hydrophile/lipophile balance (HLB). The nature of the hydrophilic group (also known as the "head") provides the most useful means for categorizing the different surfactants used in formulations (Rieger, in "Pharmaceutical Dosage Forms", Marcel Dekker, Inc., New York, N.Y., 1988, p. 285).

If the surfactant molecule is not ionized, it is classified as a nonionic surfactant. Nonionic surfactants find wide application in pharmaceutical and cosmetic products and are usable over a wide range of pH values. In general their HLB values range from 2 to about 18 depending on their structure. Nonionic surfactants include nonionic esters such as ethylene glycol esters, propylene glycol esters, glyceryl esters, polyglyceryl esters, sorbitan esters, sucrose esters, and ethoxylated esters. Nonionic alkanolamides and ethers such as fatty alcohol ethoxylates, propoxylated alcohols, and ethoxylated/propoxylated block polymers are also included in this class. The polyoxyethylene surfactants are the most popular members of the nonionic surfactant class.

If the surfactant molecule carries a negative charge when it is dissolved or dispersed in water, the surfactant is classified as anionic. Anionic surfactants include carboxylates such as soaps, acyl lactylates, acyl amides of amino acids, esters of sulfuric acid such as alkyl sulfates and ethoxylated alkyl sulfates, sulfonates such as alkyl benzene sulfonates, acyl isethionates, acyl taurates and sulfosuccinates, and phosphates. The most important members of the anionic surfactant class are the alkyl sulfates and the soaps.

If the surfactant molecule carries a positive charge when it is dissolved or dispersed in water, the surfactant is classified as cationic. Cationic surfactants include quaternary ammonium salts and ethoxylated amines. The quaternary ammonium salts are the most used members of this class.

If the surfactant molecule has the ability to carry either a positive or negative charge, the surfactant is classified as amphoteric. Amphoteric surfactants include acrylic acid derivatives, substituted alkylamides, N-alkylbetaines and phosphatides.

The use of surfactants in drug products, formulations and in emulsions has been reviewed (Rieger, in "Pharmaceutical Dosage Forms", Marcel Dekker, Inc., New York, N.Y., 1988, p. 285).

The iRNA for use in the methods of the invention can also be provided as micellar formulations. "Micelles" are defined herein as a particular type of molecular assembly in which amphipathic molecules are arranged in a spherical structure such that all the hydrophobic portions of the molecules are directed inward, leaving the hydrophilic portions in contact with the surrounding aqueous phase. The converse arrangement exists if the environment is hydrophobic.

A mixed micellar formulation suitable for delivery through transdermal membranes may be prepared by mixing an aqueous solution of iRNA, an alkali metal $C_8$ to $C_{22}$ alkyl sulphate, and a micelle forming compounds. Exemplary micelle forming compounds include lecithin, hyaluronic acid, pharmaceutically acceptable salts of hyaluronic acid, glycolic acid, lactic acid, chamomile extract, cucumber extract, oleic acid, linoleic acid, linolenic acid, monoolein, monooleates, monolaurates, borage oil, evening of primrose oil, menthol, trihydroxy oxo cholanyl glycine and pharmaceutically acceptable salts thereof, glycerin, polyglycerin, lysine, polylysine, triolein, polyoxyethylene ethers and analogues thereof, polidocanol alkyl ethers and analogues thereof, chenodeoxycholate, deoxycholate, and mixtures thereof. The micelle forming compounds may be added at the same time or after addition of the alkali metal alkyl sulphate. Mixed micelles will form with substantially any kind of mixing of the ingredients but vigorous mixing in order to provide smaller size micelles.

In one method a first micellar composition is prepared which contains the RNAi and at least the alkali metal alkyl sulphate. The first micellar composition is then mixed with at least three micelle forming compounds to form a mixed micellar composition. In another method, the micellar composition is prepared by mixing the RNAi, the alkali metal alkyl sulphate and at least one of the micelle forming compounds, followed by addition of the remaining micelle forming compounds, with vigorous mixing.

Phenol or m-cresol may be added to the mixed micellar composition to stabilize the formulation and protect against bacterial growth. Alternatively, phenol or m-cresol may be added with the micelle forming ingredients. An isotonic agent such as glycerin may also be added after formation of the mixed micellar composition.

For delivery of the micellar formulation as a spray, the formulation can be put into an aerosol dispenser and the dispenser is charged with a propellant. The propellant, which is under pressure, is in liquid form in the dispenser. The ratios of the ingredients are adjusted so that the aqueous and propellant phases become one, i.e., there is one phase. If there are two phases, it is necessary to shake the dispenser prior to dispensing a portion of the contents, e.g., through a metered valve. The dispensed dose of pharmaceutical agent is propelled from the metered valve in a fine spray.

Propellants may include hydrogen-containing chlorofluorocarbons, hydrogen-containing fluorocarbons, dimethyl ether and diethyl ether. In certain embodiments, HFA 134a (1,1,1,2 tetrafluoroethane) may be used.

The specific concentrations of the essential ingredients can be determined by relatively straightforward experimentation. For absorption through the oral cavities, it is often desirable to increase, e.g., at least double or triple, the dosage for through injection or administration through the gastrointestinal tract.

B. Lipid Particles iRNAs, e.g., dsRNAi agents of in the invention may be fully encapsulated in a lipid formulation, e.g., a LNP, or other nucleic acid-lipid particle.

As used herein, the term "LNP" refers to a stable nucleic acid-lipid particle. LNPs typically contain a cationic lipid, a non-cationic lipid, and a lipid that prevents aggregation of the particle (e.g., a PEG-lipid conjugate). LNPs are extremely useful for systemic applications, as they exhibit extended circulation lifetimes following intravenous (i.v.) injection and accumulate at distal sites (e.g., sites physically separated from the administration site). LNPs include "pSPLP," which include an encapsulated condensing agent-nucleic acid complex as set forth in PCT Publication No. WO 00/03683. The particles of the present invention typically have a mean diameter of about 50 nm to about 150 nm, more typically about 60 nm to about 130 nm, more typically about 70 nm to about 110 nm, most typically about 70 nm to about 90 nm, and are substantially nontoxic. In addition, the nucleic acids when present in the nucleic acid-lipid particles of the present invention are resistant in aqueous solution to degradation with a nuclease. Nucleic acid-lipid particles and their method of preparation are disclosed in, e.g., U.S. Pat. Nos. 5,976,567; 5,981,501; 6,534,484; 6,586,410; 6,815,432; US Publication No. 2010/0324120 and PCT Publication No. WO 96/40964.

In one embodiment, the lipid to drug ratio (mass/mass ratio) (e.g., lipid to dsRNA ratio) will be in the range of from about 1:1 to about 50:1, from about 1:1 to about 25:1, from about 3:1 to about 15:1, from about 4:1 to about 10:1, from about 5:1 to about 9:1, or about 6:1 to about 9:1. Ranges intermediate to the above recited ranges are also contemplated to be part of the invention.

The cationic lipid can be, for example, N,N-dioleyl-N,N-dimethylammonium chloride (DODAC), N,N-distearyl-N,N-dimethylammonium bromide (DDAB), N—(I-(2,3-dioleoyloxy)propyl)-N,N,N-trimethylammonium chloride (DOTAP), N—(I-(2,3-dioleyloxy)propyl)-N,N,N-trimethylammonium chloride (DOTMA), N,N-dimethyl-2,3-dioleyloxy)propylamine (DODMA), 1,2-DiLinoleyloxy-N,N-dimethylaminopropane (DLinDMA), 1,2-Dilinolenyloxy-N,N-dimethylaminopropane (DLenDMA), 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.C1), 1,2-Dilinoleoyl-3-trimethylaminopropane chloride salt (DLin-TAP.C1), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 1,2-Dilinolenyloxy-N,N-dimethylaminopropane (DLinDMA), 2,2-Dilinoleyl-4-dimethylaminomethyl-[1,3]-dioxolane (DLin-K-DMA) or analogs thereof, (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100), (6Z,9Z,28Z,31Z)-heptatriaconta-6,9,28,31-tetraen-19-yl 4-(dimethylamino)butanoate (MC3), 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1), or a mixture thereof. The cationic lipid can comprise from about 20 mol % to about 50 mol % or about 40 mol % of the total lipid present in the particle.

In some embodiments, the compound 2,2-Dilinoleyl-4-dimethylaminoethyl-[1,3]-dioxolane can be used to prepare lipid-siRNA nanoparticles.

In some embodiments, the lipid-siRNA particle includes 40% 2, 2-Dilinoleyl-4-dimethylaminoethyl-[1,3]-dioxolane: 10% DSPC: 40% Cholesterol: 10% PEG-C-DOMG (mole percent) with a particle size of 63.0±20 nm and a 0.027 siRNA/Lipid Ratio.

The ionizable/non-cationic lipid can be an anionic lipid or a neutral lipid including, but not limited to, distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoylphosphatidylethanolamine (POPE), dioleoyl-phosphatidylethanolamine 4-(N-maleimidomethyl)-cyclohexane-1-carboxylate (DOPE-mal), dipalmitoyl phosphatidyl ethanolamine (DPPE), dimyristoylphosphoethanolamine (DMPE), distearoyl-phosphatidyl-ethanolamine (DSPE), 16-O-monomethyl PE, 16-O-dimethyl PE, 18-1-trans PE, 1-stearoyl-2-oleoyl-phosphatidyethanolamine (SOPE), cholesterol, or a mixture thereof. The non-cationic lipid can be from about 5 mol % to about 90 mol %, about 10 mol %, or about 58 mol % if cholesterol is included, of the total lipid present in the particle.

The conjugated lipid that inhibits aggregation of particles can be, for example, a polyethyleneglycol (PEG)-lipid including, without limitation, a PEG-diacylglycerol (DAG), a PEG-dialkyloxypropyl (DAA), a PEG-phospholipid, a PEG-ceramide (Cer), or a mixture thereof. The PEG-DAA conjugate can be, for example, a PEG-dilauryloxypropyl ($C_{12}$), a PEG-dimyristyloxypropyl ($C_{14}$), a PEG-dipalmityloxypropyl ($C_{16}$), or a PEG-distearyloxypropyl ($C_{18}$). The conjugated lipid that prevents aggregation of particles can be from 0 mol % to about 20 mol % or about 2 mol % of the total lipid present in the particle.

In some embodiments, the nucleic acid-lipid particle further includes cholesterol at, e.g., about 10 mol % to about 60 mol % or about 48 mol % of the total lipid present in the particle.

In one embodiment, the lipidoid ND98.4HCl (MW 1487) (see U.S. patent application Ser. No. 12/056,230, filed Mar. 26, 2008, which is incorporated herein by reference), Cholesterol (Sigma-Aldrich), and PEG-Ceramide C16 (Avanti Polar Lipids) can be used to prepare lipid-dsRNA nanoparticles (i.e., LNP01 particles). Stock solutions of each in ethanol can be prepared as follows: ND98, 133 mg/ml; Cholesterol, 25 mg/ml, PEG-Ceramide C16, 100 mg/ml. The ND98, Cholesterol, and PEG-Ceramide C16 stock solutions can then be combined in a, e.g., 42:48:10 molar ratio. The combined lipid solution can be mixed with aqueous dsRNA (e.g., in sodium acetate pH 5) such that the final ethanol concentration is about 35-45% and the final sodium acetate concentration is about 100-300 mM. Lipid-dsRNA nanoparticles typically form spontaneously upon mixing. Depending on the desired particle size distribution, the resultant nanoparticle mixture can be extruded through a polycarbonate membrane (e.g., 100 nm cut-off) using, for example, a thermobarrel extruder, such as Lipex Extruder (Northern Lipids, Inc). In some cases, the extrusion step can be omitted. Ethanol removal and simultaneous buffer exchange can be accomplished by, for example, dialysis or tangential flow filtration. Buffer can be exchanged with, for example, phosphate buffered saline (PBS) at about pH 7, e.g., about pH 6.9, about pH 7.0, about pH 7.1, about pH 7.2, about pH 7.3, or about pH 7.4.

Formula 1

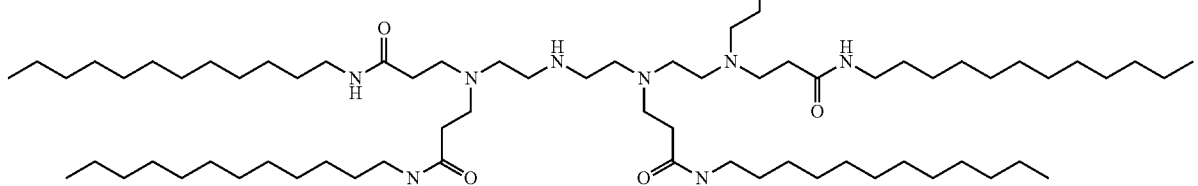

ND98 Isomer I

LNP01 formulations are described, e.g., in International Application Publication No. WO 2008/042973, which is hereby incorporated by reference.

Additional exemplary lipid-dsRNA formulations are described in Table 1.

TABLE 1

|   | Ionizable/Cationic Lipid | cationic lipid/non-cationic lipid/cholesterol/PEG-lipid conjugate Lipid:siRNA ratio |
|---|---|---|
| SNALP-1 | 1',2-Dilinolenyloxy-N,N-dimethylaminopropane (DLinDMA) | DLinDMA/DPPC/Cholesterol/PEG-cDMA (57.1/7.1/34.4/1.4) lipid:siRNA~7:1 |
| 2-XTC | 2,2-Dilinoleyl-4-dimethylaminoethyl-[1,3]-dioxolane (XTC) | XTC/DPPC/Cholesterol/PEG-cDMA 57.1/7.1/34.4/1.4 lipid:siRNA~7:1 |
| LNP05 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA~6:1 |
| LNP06 | 2,2-Dilinoleyl-4-dimethylaminoethyl-[1,3]-dioxolane (XTC) | XTC/DSPC/Cholesterol/PEG-DMG 57.5/7.5/31.5/3.5 lipid:siRNA~11:1 |
| LNP07 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA~6:1 |
| LNP08 | 2,2-Dilinoleyl-4-dimethylaminoethyl-[1,3]-dioxolane (XTC) | XTC/DSPC/Cholesterol/PEG-DMG 60/7.5/31/1.5, lipid:siRNA~11:1 |
| LNP09 | 2,2-Dilinoleyl-4-dimethylaminoethy1-[1,3]-dioxolane (XTC) | XTC/DSPC/Cholesterol/PEG-DMG 50/10/38.5/1.5 Lipid:siRNA 10:1 |
| LNP10 | (3aR,5s,6aS)-N,N-dimethyl-2,2-di((9Z,12Z)-octadeca-9,12-dienyl)tetrahydro-3aH-cyclopenta[d][1,3]dioxol-5-amine (ALN100) | ALN100/DSPC/Cholesterol/PEG-DMG 50/10/38.5/1.5 Lipid:siRNA 10:1 |
| LNP11 | (6Z,9Z,28Z,31Z)-heptatriaconta-6,9,28,31-tetraen-19-yl 4-(dimethylamino)butanoate (MC3) | MC-3/DSPC/Cholesterol/PEG-DMG 50/10/38.5/1.5 Lipid:siRNA 10:1 |
| LNP12 | 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (Tech G1) | Tech G1/DSPC/Cholesterol/PEG-DMG 50/10/38.5/1.5 Lipid:siRNA 10:1 |
| LNP13 | XTC | XTC/DSPC/Chol/PEG-DMG 50/10/38.5/1.5 Lipid:siRNA: 33:1 |
| LNP14 | MC3 | MC3/DSPC/Chol/PEG-DMG 40/15/40/5 Lipid:siRNA: 11:1 |
| LNP15 | MC3 | MC3/DSPC/Chol/PEG-DSG/GalNAc-PEG-DSG 50/10/35/4.5/0.5 Lipid:siRNA: 11:1 |
| LNP16 | MC3 | MC3/DSPC/Chol/PEG-DMG 50/10/38.5/1.5 Lipid:siRNA: 7:1 |
| LNP17 | MC3 | MC3/DSPC/Chol/PEG-DSG 50/10/38.5/1.5 Lipid:siRNA: 10:1 |
| LNP18 | MC3 | MC3/DSPC/Chol/PEG-DMG 50/10/38.5/1.5 Lipid:siRNA: 12:1 |
| LNP19 | MC3 | MC3/DSPC/Chol/PEG-DMG 50/10/35/5 Lipid:siRNA: 8:1 |
| LNP20 | MC3 | MC3/DSPC/Chol/PEG-DPG 50/10/38.5/1.5 Lipid:siRNA: 10:1 |
| LNP21 | C12-200 | C12-200/DSPC/Chol/PEG-DSG 50/10/38.5/1.5 Lipid:siRNA: 7:1 |

TABLE 1-continued

| | Ionizable/Cationic Lipid | cationic lipid/non-cationic lipid/cholesterol/PEG-lipid conjugate Lipid:siRNA ratio |
|---|---|---|
| LNP22 | XTC | XTC/DSPC/Chol/PEG-DSG 50/10/38.5/1.5 Lipid:siRNA: 10:1 |

DSPC: distearoylphosphatidylcholine
DPPC: dipalmitoylphosphatidylcholine
PEG-DMG: PEG-didimyristoyl glycerol (C14-PEG, or PEG-C14) (PEG with avg mol wt of 2000)
PEG-DSG: PEG-distyryl glycerol (C18-PEG, or PEG-C18) (PEG with avg mol wt of 2000)
PEG-cDMA: PEG-carbamoyl-1,2-dimyristyloxypropylamine (PEG with avg mol wt of 2000)
SNALP (1,2-Dilinolenyloxy-N,N-dimethylaminopropane (DLinDMA)) comprising formulations are described in International Publication No. WO2009/127060, filed Apr. 15, 2009, which is hereby incorporated by reference.
XTC comprising formulations are described, e.g., in International Patent Application No. PCT/US2010/022614, filed on Jan. 29, 2010, the entire content of which are hereby incorporated by reference.
MC3 comprising formulations are described, e.g., in US Patent Publication No. 2010/0324120, filed on Jun. 10, 2010, the entire contents of which are hereby incorporated by reference.
ALNY-100 comprising formulations are described, e.g., International Patent Application Number PCT/US09/63933, filed on Nov. 10, 2009, the entire contents of which are hereby incorporated by reference.
C12-200 comprising formulations are described in PCT Publication No. WO 2010/129709, the entire contents of which are hereby incorporated by reference.

Compositions and formulations for oral administration include powders or granules, microparticulates, nanoparticulates, suspensions or solutions in water or non-aqueous media, capsules, gel capsules, sachets, tablets or minitablets. Thickeners, flavoring agents, diluents, emulsifiers, dispersing aids, or binders can be desirable. In some embodiments, oral formulations are those in which dsRNAs featured in the invention are administered in conjunction with one or more penetration enhancer surfactants and chelators. Suitable surfactants include fatty acids or esters or salts thereof, bile acids or salts thereof. Suitable bile acids/salts include chenodeoxycholic acid (CDCA) and ursodeoxychenodeoxycholic acid (UDCA), cholic acid, dehydrocholic acid, deoxycholic acid, glucholic acid, glycholic acid, glycodeoxycholic acid, taurocholic acid, taurodeoxycholic acid, sodium tauro-24,25-dihydro-fusidate and sodium glycodihydrofusidate. Suitable fatty acids include arachidonic acid, undecanoic acid, oleic acid, lauric acid, caprylic acid, capric acid, myristic acid, palmitic acid, stearic acid, linoleic acid, linolenic acid, dicaprate, tricaprate, monoolein, dilaurin, glyceryl 1-monocaprate, 1-dodecylazacycloheptan-2-one, an acylcarnitine, an acylcholine, or a monoglyceride, a diglyceride or a pharmaceutically acceptable salt thereof (e.g., sodium). In some embodiments, combinations of penetration enhancers are used, for example, fatty acids/salts in combination with bile acids/salts. One exemplary combination is the sodium salt of lauric acid, capric acid and UDCA. Further penetration enhancers include polyoxyethylene-9-lauryl ether, polyoxyethylene-20-cetyl ether. DsRNAs featured in the invention can be delivered orally, in granular form including sprayed dried particles, or complexed to form micro or nanoparticles. DsRNA complexing agents include poly-amino acids; polyimines; polyacrylates; polyalkylacrylates, polyoxethanes, polyalkylcyanoacrylates; cationized gelatins, albumins, starches, acrylates, polyethyleneglycols (PEG), and starches; polyalkylcyanoacrylates; DEAE-derivatized polyimines, pollulans, celluloses, and starches. Suitable complexing agents include chitosan, N-trimethylchitosan, poly-L-lysine, polyhistidine, polyornithine, polyspermines, protamine, polyvinylpyridine, polythiodiethylaminomethylethylene P(TDAE), polyaminostyrene (e.g., p-amino), poly(methylcyanoacrylate), poly(ethylcyanoacrylate), poly(butylcyanoacrylate), poly(isobutylcyanoacrylate), poly(isohexylcynaoacrylate), DEAE-methacrylate, DEAE-hexylacrylate, DEAE-acrylamide, DEAE-albumin and DEAE-dextran, polymethylacrylate, polyhexylacrylate, poly(D,L-lactic acid), poly(DL-lactic-co-glycolic acid (PLGA), alginate, and polyethyleneglycol (PEG). Oral formulations for dsRNAs and their preparation are described in detail in U.S. Pat. No. 6,887,906, US Publn. No. 20030027780, and U.S. Pat. No. 6,747,014, each of which is incorporated herein by reference.

Compositions and formulations for parenteral, intraparenchymal (into the brain), intrathecal, intraventricular or intrahepatic administration can include sterile aqueous solutions which can also contain buffers, diluents, and other suitable additives such as, but not limited to, penetration enhancers, carrier compounds, and other pharmaceutically acceptable carriers or excipients.

Pharmaceutical compositions of the present invention include, but are not limited to, solutions, emulsions, and liposome-containing formulations. These compositions can be generated from a variety of components that include, but are not limited to, preformed liquids, self-emulsifying solids, and self-emulsifying semisolids. Formulations include those that target the liver when treating hepatic disorders such as hepatic carcinoma.

The pharmaceutical formulations of the present invention, which can conveniently be presented in unit dosage form, can be prepared according to conventional techniques well known in the pharmaceutical industry. Such techniques include the step of bringing into association the active ingredients with the pharmaceutical carrier(s) or excipient(s). In general, the formulations are prepared by uniformly and intimately bringing into association the active ingredients with liquid carriers or finely divided solid carriers or both, and then, if necessary, shaping the product.

The compositions of the present invention can be formulated into any of many possible dosage forms such as, but not limited to, tablets, capsules, gel capsules, liquid syrups, soft gels, suppositories, and enemas. The compositions of the present invention can also be formulated as suspensions in aqueous, non-aqueous or mixed media. Aqueous suspensions can further contain substances which increase the viscosity of the suspension including, for example, sodium carboxymethylcellulose, sorbitol or dextran. The suspension can also contain stabilizers.

C. Additional Formulations
i. Emulsions

The iRNAs of the present invention can be prepared and formulated as emulsions. Emulsions are typically heterogeneous systems of one liquid dispersed in another in the form of droplets usually exceeding 0.1 µm in diameter (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199; Rosoff, in Pharmaceutical Dosage Forms, Lieberman, Rieger and Banker (Eds.), 1988, Marcel Dekker, Inc., New York, N.Y., Volume 1, p. 245; Block in Pharmaceutical Dosage Forms, Lieberman, Rieger and Banker (Eds.), 1988, Marcel Dekker, Inc., New York, N.Y., volume 2, p. 335; Higuchi et al., in Remington's Pharmaceutical Sciences, Mack Publishing Co., Easton, Pa., 1985, p. 301). Emulsions are often biphasic systems comprising two immiscible liquid phases intimately mixed and dispersed with each other. In general, emulsions can be of either the water-in-oil (w/o) or the oil-in-water (o/w) variety. When an aqueous phase is finely divided into and dispersed as minute droplets into a bulk oily phase, the resulting composition is called a water-in-oil (w/o) emulsion. Alternatively, when an oily phase is finely divided into and dispersed as minute droplets into a bulk aqueous phase, the resulting composition is called an oil-in-water (o/w) emulsion. Emulsions can contain additional components in addition to the dispersed phases, and the active drug which can be present as a solution either in the aqueous phase, oily phase or itself as a separate phase. Pharmaceutical excipients such as emulsifiers, stabilizers, dyes, and anti-oxidants can also be present in emulsions as needed. Pharmaceutical emulsions can also be multiple emulsions that are comprised of more than two phases such as, for example, in the case of oil-in-water-in-oil (o/w/o) and water-in-oil-in-water (w/o/w) emulsions. Such complex formulations often provide certain advantages that simple binary emulsions do not. Multiple emulsions in which individual oil droplets of an o/w emulsion enclose small water droplets constitute a w/o/w emulsion. Likewise a system of oil droplets enclosed in globules of water stabilized in an oily continuous phase provides an o/w/o emulsion.

Emulsions are characterized by little or no thermodynamic stability. Often, the dispersed or discontinuous phase of the emulsion is well dispersed into the external or continuous phase and maintained in this form through the means of emulsifiers or the viscosity of the formulation. Either of the phases of the emulsion can be a semisolid or a solid, as is the case of emulsion-style ointment bases and creams. Other means of stabilizing emulsions entail the use of emulsifiers that can be incorporated into either phase of the emulsion. Emulsifiers can broadly be classified into four categories: synthetic surfactants, naturally occurring emulsifiers, absorption bases, and finely dispersed solids (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199).

Synthetic surfactants, also known as surface active agents, have found wide applicability in the formulation of emulsions and have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rieger, in Pharmaceutical Dosage Forms, Lieberman, Rieger and Banker (Eds.), 1988, Marcel Dekker, Inc., New York, N.Y., volume 1, p. 285; Idson, in Pharmaceutical Dosage Forms, Lieberman, Rieger and Banker (Eds.), Marcel Dekker, Inc., New York, N.Y., 1988, volume 1, p. 199).

Surfactants are typically amphiphilic and comprise a hydrophilic and a hydrophobic portion. The ratio of the hydrophilic to the hydrophobic nature of the surfactant has been termed the hydrophile/lipophile balance (HLB) and is a valuable tool in categorizing and selecting surfactants in the preparation of formulations. Surfactants can be classified into different classes based on the nature of the hydrophilic group: nonionic, anionic, cationic, and amphoteric (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y. Rieger, in Pharmaceutical Dosage Forms, Lieberman, Rieger and Banker (Eds.), 1988, Marcel Dekker, Inc., New York, N.Y., volume 1, p. 285).

Naturally occurring emulsifiers used in emulsion formulations include lanolin, beeswax, phosphatides, lecithin and acacia. Absorption bases possess hydrophilic properties such that they can soak up water to form w/o emulsions yet retain their semisolid consistencies, such as anhydrous lanolin and hydrophilic petrolatum. Finely divided solids have also been used as good emulsifiers especially in combination with surfactants and in viscous preparations. These include polar inorganic solids, such as heavy metal hydroxides, nonswelling clays such as bentonite, attapulgite, hectorite, kaolin, montmorillonite, colloidal aluminum silicate, and colloidal magnesium aluminum silicate, pigments and nonpolar solids such as carbon or glyceryl tristearate.

A large variety of non-emulsifying materials are also included in emulsion formulations and contribute to the properties of emulsions. These include fats, oils, waxes, fatty acids, fatty alcohols, fatty esters, humectants, hydrophilic colloids, preservatives, and antioxidants (Block, in Pharmaceutical Dosage Forms, Lieberman, Rieger and Banker (Eds.), 1988, Marcel Dekker, Inc., New York, N.Y., volume 1, p. 335; Idson, in Pharmaceutical Dosage Forms, Lieberman, Rieger and Banker (Eds.), 1988, Marcel Dekker, Inc., New York, N.Y., volume 1, p. 199).

Hydrophilic colloids or hydrocolloids include naturally occurring gums and synthetic polymers such as polysaccharides (for example, acacia, agar, alginic acid, carrageenan, guar gum, karaya gum, and tragacanth), cellulose derivatives (for example, carboxymethylcellulose and carboxypropylcellulose), and synthetic polymers (for example, carbomers, cellulose ethers, and carboxyvinyl polymers). These disperse or swell in water to form colloidal solutions that stabilize emulsions by forming strong interfacial films around the dispersed-phase droplets and by increasing the viscosity of the external phase.

Since emulsions often contain a number of ingredients such as carbohydrates, proteins, sterols and phosphatides that can readily support the growth of microbes, these formulations often incorporate preservatives. Commonly used preservatives included in emulsion formulations include methyl paraben, propyl paraben, quaternary ammonium salts, benzalkonium chloride, esters of p-hydroxybenzoic acid, and boric acid. Antioxidants are also commonly added to emulsion formulations to prevent deterioration of the formulation. Antioxidants used can be free radical scavengers such as tocopherols, alkyl gallates, butylated hydroxyanisole, butylated hydroxytoluene, or reducing agents such as ascorbic acid and sodium metabisulfite, and antioxidant synergists such as citric acid, tartaric acid, and lecithin.

The application of emulsion formulations via dermatological, oral, and parenteral routes, and methods for their manufacture have been reviewed in the literature (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Idson, in Pharmaceutical Dosage Forms, Lieberman, Rieger and Banker (Eds.), 1988, Marcel Dekker, Inc., New York, N.Y., volume 1, p. 199). Emulsion formulations for oral delivery have been very widely used because of ease of formulation, as well as efficacy from an absorption and bioavailability standpoint (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Idson, in Pharmaceutical Dosage Forms, Lieberman, Rieger and Banker (Eds.), 1988, Marcel Dekker, Inc., New York, N.Y., volume 1, p. 199). Mineral-oil base laxatives, oil-soluble vitamins, and high fat nutritive preparations are among the materials that have commonly been administered orally as o/w emulsions.

ii. Microemulsions

In one embodiment of the present invention, the iRNAs are formulated as microemulsions. A microemulsion can be defined as a system of water, oil, and amphiphile which is a single optically isotropic and thermodynamically stable liquid solution (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245). Typically microemulsions are systems that are prepared by first dispersing an oil in an aqueous surfactant solution and then adding a sufficient amount of a fourth component, generally an intermediate chain-length alcohol to form a transparent system. Therefore, microemulsions have also been described as thermodynamically stable, isotropically clear dispersions of two immiscible liquids that are stabilized by interfacial films of surface-active molecules (Leung and Shah, in: Controlled Release of Drugs: Polymers and Aggregate Systems, Rosoff, M., Ed., 1989, VCH Publishers, New York, pages 185-215). Microemulsions commonly are prepared via a combination of three to five components that include oil, water, surfactant, cosurfactant and electrolyte. Whether the microemulsion is of the water-in-oil (w/o) or an oil-in-water (o/w) type is dependent on the properties of the oil and surfactant used and on the structure and geometric packing of the polar heads and hydrocarbon tails of the surfactant molecules (Schott, in Remington's Pharmaceutical Sciences, Mack Publishing Co., Easton, Pa., 1985, p. 271).

The phenomenological approach utilizing phase diagrams has been extensively studied and has yielded a comprehensive knowledge, to one skilled in the art, of how to formulate microemulsions (see e.g., Ansel's Pharmaceutical Dosage Forms and Drug Delivery Systems, Allen, L V., Popovich N G., and Ansel H C., 2004, Lippincott Williams & Wilkins (8th ed.), New York, N.Y.; Rosoff, in Pharmaceutical Dosage Forms, Lieberman, Rieger and Banker (Eds.), 1988, Marcel Dekker, Inc., New York, N.Y., volume 1, p. 245; Block, in Pharmaceutical Dosage Forms, Lieberman, Rieger and Banker (Eds.), 1988, Marcel Dekker, Inc., New York, N.Y., volume 1, p. 335). Compared to conventional emulsions, microemulsions offer the advantage of solubilizing water-insoluble drugs in a formulation of thermodynamically stable droplets that are formed spontaneously.

Surfactants used in the preparation of microemulsions include, but are not limited to, ionic surfactants, non-ionic surfactants, Brij® 96, polyoxyethylene oleyl ethers, polyglycerol fatty acid esters, tetraglycerol monolaurate (ML310), tetraglycerol monooleate (MO310), hexaglycerol monooleate (PO310), hexaglycerol pentaoleate (PO500), decaglycerol monocaprate (MCA750), decaglycerol monooleate (MO750), decaglycerol sequioleate (SO750), decaglycerol decaoleate (DAO750), alone or in combination with cosurfactants. The cosurfactant, usually a short-chain alcohol such as ethanol, 1-propanol, and 1-butanol, serves to increase the interfacial fluidity by penetrating into the surfactant film and consequently creating a disordered film because of the void space generated among surfactant molecules. Microemulsions can, however, be prepared without the use of cosurfactants and alcohol-free self-emulsifying microemulsion systems are known in the art. The aqueous phase can typically be, but is not limited to, water, an aqueous solution of the drug, glycerol, PEG300, PEG400, polyglycerols, propylene glycols, and derivatives of ethylene glycol. The oil phase can include, but is not limited to, materials such as Captex® 300, Captex® 355, Capmul® MCM, fatty acid esters, medium chain (C8-C12) mono, di, and tri-glycerides, polyoxyethylated glyceryl fatty acid esters, fatty alcohols, polyglycolized glycerides, saturated polyglycolized C8-C10 glycerides, vegetable oils, and silicone oil.

Microemulsions are particularly of interest from the standpoint of drug solubilization and the enhanced absorption of drugs. Lipid based microemulsions (both o/w and w/o) have been proposed to enhance the oral bioavailability of drugs, including peptides (see e.g., U.S. Pat. Nos. 6,191,105; 7,063,860; 7,070,802; 7,157,099; Constantinides et al., Pharmaceutical Research, 1994, 11, 1385-1390; Ritschel, Meth. Find. Exp. Clin. Pharmacol., 1993, 13, 205). Microemulsions afford advantages of improved drug solubilization, protection of drug from enzymatic hydrolysis, possible enhancement of drug absorption due to surfactant-induced alterations in membrane fluidity and permeability, ease of preparation, ease of oral administration over solid dosage forms, improved clinical potency, and decreased toxicity (see e.g., U.S. Pat. Nos. 6,191,105; 7,063,860; 7,070,802; 7,157,099; Constantinides et al., Pharmaceutical Research, 1994, 11, 1385; Ho et al., J. Pharm. Sci., 1996, 85, 138-143). Often microemulsions can form spontaneously when their components are brought together at ambient temperature. This can be particularly advantageous when formulating thermolabile drugs, peptides or iRNAs. Microemulsions have also been effective in the transdermal delivery of active components in both cosmetic and pharmaceutical applications. It is expected that the microemulsion compositions and formulations of the present invention will facilitate the increased systemic absorption of iRNAs and nucleic acids from the gastrointestinal tract, as well as improve the local cellular uptake of iRNAs and nucleic acids.

Microemulsions of the present invention can also contain additional components and additives such as sorbitan monostearate (Grill® 3), Labrasol®, and penetration enhancers to improve the properties of the formulation and to enhance the absorption of the iRNAs and nucleic acids of the present invention. Penetration enhancers used in the microemulsions of the present invention can be classified as belonging to one of five broad categories—surfactants, fatty acids, bile salts, chelating agents, and non-chelating non-surfactants (Lee et al., Critical Reviews in Therapeutic Drug Carrier Systems, 1991, p. 92). Each of these classes has been discussed above.

iii. Microparticles

An iRNA of the invention may be incorporated into a particle, e.g., a microparticle. Microparticles can be produced by spray-drying, but may also be produced by other methods including lyophilization, evaporation, fluid bed drying, vacuum drying, or a combination of these techniques.

iv. Penetration Enhancers

In one embodiment, the present invention employs various penetration enhancers to effect the efficient delivery of nucleic acids, particularly iRNAs, to the skin of animals. Most drugs are present in solution in both ionized and nonionized forms. However, usually only lipid soluble or lipophilic drugs readily cross cell membranes. It has been discovered that even non-lipophilic drugs can cross cell membranes if the membrane to be crossed is treated with a penetration enhancer. In addition to aiding the diffusion of non-lipophilic drugs across cell membranes, penetration enhancers also enhance the permeability of lipophilic drugs.

Penetration enhancers can be classified as belonging to one of five broad categories, i.e., surfactants, fatty acids, bile salts, chelating agents, and non-chelating non-surfactants (see e.g., Malmsten, M. Surfactants and polymers in drug delivery, Informa Health Care, New York, N.Y., 2002; Lee et al., Critical Reviews in Therapeutic Drug Carrier Systems, 1991, p. 92). Such compounds are well known in the art.

v. Carriers

Certain compositions of the present invention also incorporate carrier compounds in the formulation. As used herein, "carrier compound" or "carrier" can refer to a nucleic acid, or analog thereof, which is inert (i.e., does not possess biological activity per se) but is recognized as a nucleic acid by in vivo processes that reduce the bioavailability of a nucleic acid having biological activity by, for example, degrading the biologically active nucleic acid or promoting its removal from circulation. The coadministration of a nucleic acid and a carrier compound, typically with an excess of the latter substance, can result in a substantial reduction of the amount of nucleic acid recovered in the liver, kidney or other extracirculatory reservoirs, presumably due to competition between the carrier compound and the nucleic acid for a common receptor. For example, the recovery of a partially phosphorothioate dsRNA in hepatic tissue can be reduced when it is coadministered with polyinosinic acid, dextran sulfate, polycytidic acid or 4-acetamido-4'isothiocyano-stilbene-2,2'-disulfonic acid (Miyao et al., DsRNA Res. Dev., 1995, 5, 115-121; Takakura et al., DsRNA & Nucl. Acid Drug Dev., 1996, 6, 177-183.

vi. Excipients

In contrast to a carrier compound, a "pharmaceutical carrier" or "excipient" is a pharmaceutically acceptable solvent, suspending agent, or any other pharmacologically inert vehicle for delivering one or more nucleic acids to an animal. The excipient can be liquid or solid and is selected, with the planned manner of administration in mind, so as to provide for the desired bulk, consistency, etc., when combined with a nucleic acid and the other components of a given pharmaceutical composition. Typical pharmaceutical carriers include, but are not limited to, binding agents (e.g., pregelatinized maize starch, polyvinylpyrrolidone or hydroxypropyl methylcellulose, etc.); fillers (e.g., lactose and other sugars, microcrystalline cellulose, pectin, gelatin, calcium sulfate, ethyl cellulose, polyacrylates or calcium hydrogen phosphate, etc.); lubricants (e.g., magnesium stearate, talc, silica, colloidal silicon dioxide, stearic acid, metallic stearates, hydrogenated vegetable oils, corn starch, polyethylene glycols, sodium benzoate, sodium acetate, etc.); disintegrants (e.g., starch, sodium starch glycolate, etc.); and wetting agents (e.g., sodium lauryl sulphate, etc).

Pharmaceutically acceptable organic or inorganic excipients suitable for non-parenteral administration which do not deleteriously react with nucleic acids can also be used to formulate the compositions of the present invention. Suitable pharmaceutically acceptable carriers include, but are not limited to, water, salt solutions, alcohols, polyethylene glycols, gelatin, lactose, amylose, magnesium stearate, talc, silicic acid, viscous paraffin, hydroxymethylcellulose, polyvinylpyrrolidone, and the like.

Formulations for topical administration of nucleic acids can include sterile and non-sterile aqueous solutions, non-aqueous solutions in common solvents such as alcohols, or solutions of the nucleic acids in liquid or solid oil bases. The solutions can also contain buffers, diluents and other suitable additives. Pharmaceutically acceptable organic or inorganic excipients suitable for non-parenteral administration which do not deleteriously react with nucleic acids can be used.

Suitable pharmaceutically acceptable excipients include, but are not limited to, water, salt solutions, alcohol, polyethylene glycols, gelatin, lactose, amylose, magnesium stearate, talc, silicic acid, viscous paraffin, hydroxymethylcellulose, polyvinylpyrrolidone, and the like.

vii. Other Components

The compositions of the present invention can additionally contain other adjunct components conventionally found in pharmaceutical compositions, at their art-established usage levels. Thus, for example, the compositions can contain additional, compatible, pharmaceutically-active materials such as, for example, antipruritics, astringents, local anesthetics or anti-inflammatory agents, or can contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings or aromatic substances and the like which do not deleteriously interact with the nucleic acid(s) of the formulation.

Aqueous suspensions can contain substances which increase the viscosity of the suspension including, for example, sodium carboxymethylcellulose, sorbitol, or dextran. The suspension can also contain stabilizers.

In some embodiments, pharmaceutical compositions featured in the invention include (a) one or more iRNA and (b) one or more agents which function by a non-iRNA mechanism and which are useful in treating an XDH-associated disorder.

Toxicity and therapeutic efficacy of such compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds that exhibit high therapeutic indices are preferred.

The data obtained from cell culture assays and animal studies can be used in formulating a range of dosage for use in humans. The dosage of compositions featured in the invention lies generally within a range of circulating concentrations that include the ED50 with little or no toxicity. The dosage can vary within this range depending upon the dosage form employed and the route of administration utilized. For any compound used in the methods featured in the invention, the therapeutically effective dose can be estimated initially from cell culture assays. A dose can be formulated in animal models to achieve a circulating plasma concentration range of the compound or, when appropriate, of the polypeptide product of a target sequence (e.g., achieving a decreased concentration of the polypeptide) that includes the IC50 (i.e., the concentration of the test compound which achieves a half-maximal inhibition of symptoms) as determined in cell culture. Such information can be used to more accurately determine useful doses in humans. Levels in plasma can be measured, for example, by high performance liquid chromatography.

In addition to their administration, as discussed above, the iRNAs featured in the invention can be administered in combination with other known agents effective in treatment of pathological processes mediated by XDH expression. In any event, the administering physician can adjust the amount and timing of iRNA administration on the basis of results observed using standard measures of efficacy known in the art or described herein.

VI. Methods For Inhibiting XDH Expression

The present invention also provides methods of inhibiting expression of an XDH gene in a cell. The methods include contacting a cell with an RNAi agent, e.g., double stranded RNAi agent, in an amount effective to inhibit expression of XDH in the cell, thereby inhibiting expression of XDH in the cell.

Contacting of a cell with an iRNA, e.g., a double stranded RNAi agent, may be done in vitro or in vivo. Contacting a cell in vivo with the iRNA includes contacting a cell or group of cells within a subject, e.g., a human subject, with the iRNA. Combinations of in vitro and in vivo methods of contacting a cell are also possible. Contacting a cell may be direct or indirect, as discussed above. Furthermore, contacting a cell may be accomplished via a targeting ligand, including any ligand described herein or known in the art. In preferred embodiments, the targeting ligand is a carbohydrate moiety, e.g., a GalNAc$_3$ ligand, or any other ligand that directs the RNAi agent to a site of interest.

The term "inhibiting," as used herein, is used interchangeably with "reducing," "silencing," "downregulating", "suppressing", and other similar terms, and includes any level of inhibition.

The phrase "inhibiting expression of an XDH" is intended to refer to inhibition of expression of any XDH gene (such as, e.g., a mouse XDH gene, a rat XDH gene, a monkey XDH gene, or a human XDH gene) as well as variants or mutants of an XDH gene. Thus, the XDH gene may be a wild-type XDH gene, a mutant XDH gene (such as a mutant XDH gene giving rise to abnormal uric acid metabolism), or a transgenic XDH gene in the context of a genetically manipulated cell, group of cells, or organism.

"Inhibiting expression of an XDH gene" includes any level of inhibition of an XDH gene, e.g., at least partial suppression of the expression of an XDH gene, inhibition of XDH in certain cells or tissues. The expression of the XDH gene may be assessed based on the level, or the change in the level, of any variable associated with XDH gene expression, e.g., XDH mRNA level or XDH protein level. This level may be assessed in an individual cell or in a group of cells, including, for example, a sample derived from a subject.

Inhibition may be assessed by a decrease in an absolute or relative level of one or more variables that are associated with XDH expression compared with a control level. The control level may be any type of control level that is utilized in the art, e.g., a pre-dose baseline level, or a level determined from a similar subject, cell, or sample that is untreated or treated with a control (such as, e.g., buffer only control or inactive agent control).

In some embodiments of the methods of the invention, expression of an XDH gene is inhibited by at least 15%, 20%, 25%, preferably at least 30%, 35%, 40%, 45%, 50%, 55%, 60%, 65%, 70%, 75%, 80%, 85%, 90%, or 95%, or to below the level of detection of the assay. In some embodiments, the inhibition of expression of an XDH gene results in normalization of the level of the XDH gene such that the difference between the level before treatment and a normal control level is reduced by at least 30%, 35%, 40%, 45%, 50%, 55%, 60%, 65%, 70%, 75%, 80%, 85%, 90%, or 95%. In some embodiments, the inhibition is a clinically relevant inhibition.

Inhibition of the expression of an XDH gene may be manifested by a reduction of the amount of mRNA expressed by a first cell or group of cells (such cells may be present, for example, in a sample derived from a subject) in which an XDH gene is transcribed and which has or have been treated (e.g., by contacting the cell or cells with an iRNA of the invention, or by administering an iRNA of the invention to a subject in which the cells are or were present) such that the expression of an XDH gene is inhibited, as compared to a second cell or group of cells substantially identical to the first cell or group of cells but which has not or have not been so treated (control cell(s) not treated with an iRNA or not treated with an iRNA targeted to the gene of interest). In preferred embodiments, the inhibition is assessed by the method provided in Example 2 with in vitro assays being performed in an appropriately matched cell line with the duplex at a 10 nM concentration, and expressing the level of mRNA in treated cells as a percentage of the level of mRNA in control cells, using the following formula:

$$\frac{(mRNA \text{ in control cells}) - (mRNA \text{ in treated cells})}{(mRNA \text{ in control cells})} \cdot 100\%$$

In other embodiments, inhibition of the expression of an XDH gene may be assessed in terms of a reduction of a parameter that is functionally linked to XDH gene expression, e.g., serum uric acid levels. XDH gene silencing may be determined in any cell expressing XDH, either endogenous or heterologous from an expression construct, and by any assay known in the art.

Inhibition of the expression of an XDH protein may be manifested by a reduction in the level of the XDH protein that is expressed by a cell or group of cells (e.g., the level of protein expressed in a sample derived from a subject). As explained above, for the assessment of mRNA suppression, the inhibition of protein expression levels in a treated cell or group of cells may similarly be expressed as a percentage of the level of protein in a control cell or group of cells. For example, inhibition of expression can be inhibition of expression in liver cells.

A control cell or group of cells that may be used to assess the inhibition of the expression of an XDH gene includes a cell or group of cells that has not yet been contacted with an RNAi agent of the invention. For example, the control cell or group of cells may be derived from an individual subject (e.g., a human or animal subject) prior to treatment of the subject with an RNAi agent.

The level of XDH mRNA that is expressed by a cell or group of cells, or the level of circulating XDH mRNA, may be determined using any method known in the art for assessing mRNA expression. In one embodiment, the level of expression of XDH in a sample is determined by detecting a transcribed polynucleotide, or portion thereof, e.g., mRNA of the XDH gene. RNA may be extracted from cells using RNA extraction techniques including, for example, using acid phenol/guanidine isothiocyanate extraction (RNAzol B; Biogenesis), RNeasy™ RNA preparation kits (Qiagen®) or PAXgene (PreAnalytix, Switzerland). Typical assay formats utilizing ribonucleic acid hybridization include nuclear run-on assays, RT-PCR, RNase protection assays, northern blotting, in situ hybridization, and microarray analysis. In preferred embodiments, the RT-PCR assay provided in Example 2, with in vitro assays being performed in an appropriately matched cell line with the duplex at a 10 nM concentration, is used to detect the level of expression of the mRNA.

In some embodiments, the level of expression of XDH is determined using a nucleic acid probe. The term "probe", as used herein, refers to any molecule that is capable of selectively binding to a specific XDH. Probes can be synthesized by one of skill in the art, or derived from appropriate biological preparations. Probes may be specifically designed to be labeled. Examples of molecules that can be utilized as probes include, but are not limited to, RNA, DNA, proteins, antibodies, and organic molecules.

Isolated mRNA can be used in hybridization or amplification assays that include, but are not limited to, Southern or northern analyses, polymerase chain reaction (PCR) analyses and probe arrays. One method for the determination of mRNA levels involves contacting the isolated mRNA with a nucleic acid molecule (probe) that can hybridize to XDH mRNA. In one embodiment, the mRNA is immobilized on a solid surface and contacted with a probe, for example by running the isolated mRNA on an agarose gel and transferring the mRNA from the gel to a membrane, such as nitrocellulose. In an alternative embodiment, the probe(s) are immobilized on a solid surface and the mRNA is contacted with the probe(s), for example, in an Affymetrix gene chip array. A skilled artisan can readily adapt known mRNA detection methods for use in determining the level of XDH mRNA.

An alternative method for determining the level of expression of XDH in a sample involves the process of nucleic acid amplification or reverse transcriptase (to prepare cDNA) of for example mRNA in the sample, e.g., by RT-PCR (the experimental embodiment set forth in Mullis, 1987, U.S. Pat. No. 4,683,202), ligase chain reaction (Barany (1991) *Proc. Natl. Acad. Sci. USA* 88:189-193), self sustained sequence replication (Guatelli et al. (1990) *Proc. Natl. Acad. Sci. USA* 87:1874-1878), transcriptional amplification system (Kwoh et al. (1989) *Proc. Natl. Acad. Sci. USA* 86:1173-1177), Q-Beta Replicase (Lizardi et al. (1988) *Bio/Technology* 6:1197), rolling circle replication (Lizardi et al., U.S. Pat. No. 5,854,033) or any other nucleic acid amplification method, followed by the detection of the amplified molecules using techniques well known to those of skill in the art. These detection schemes are especially useful for the detection of nucleic acid molecules if such molecules are present in very low numbers. In particular aspects of the invention, the level of expression of XDH is determined by quantitative fluorogenic RT-PCR (i.e., the TaqMan™ System) using the methods provided herein.

The expression levels of XDH mRNA may be monitored using a membrane blot (such as used in hybridization analysis such as northern, Southern, dot, and the like), or microwells, sample tubes, gels, beads or fibers (or any solid support comprising bound nucleic acids). See U.S. Pat. Nos. 5,770,722, 5,874,219, 5,744,305, 5,677,195 and 5,445,934, which are incorporated herein by reference. The determination of XDH expression level may also comprise using nucleic acid probes in solution.

In preferred embodiments, the level of mRNA expression is assessed using branched DNA (bDNA) assays or real time PCR (qPCR). The use of these methods is described and exemplified in the Examples presented herein.

The level of XDH protein expression may be determined using any method known in the art for the measurement of protein levels. Such methods include, for example, electrophoresis, capillary electrophoresis, high performance liquid chromatography (HPLC), thin layer chromatography (TLC), hyperdiffusion chromatography, fluid or gel precipitin reactions, absorption spectroscopy, a colorimetric assays, spectrophotometric assays, flow cytometry, immunodiffusion (single or double), immunoelectrophoresis, western blotting, radioimmunoassay (RIA), enzyme-linked immunosorbent assays (ELISAs), immunofluorescent assays, electrochemiluminescence assays, and the like.

In some embodiments, the efficacy of the methods of the invention in the treatment of an XDH-related disease is assessed by a decrease in XDH mRNA level (by liver biopsy) or XDH protein level, typically determined in serum.

In some embodiments, the efficacy of the compositions methods of the invention in the treatment of hyperuricemia is demonstated by a significant decrease in chronic uric acid levels in a subject to 6.8 mg/dl or less (the level of solubility of uric acid in serum), preferably 6 mg/dl or less. Studies of subjects with inherited disorders associated with profound, lifelong hypouricemia indicate that maintaining serum uric acid near or below 2 mg/dl is safe (Hershfeld, *Curr. Opin. Rheumatol.* 21:138-142, 2009). As elevated levels of serum uric acid are associated with a number of diseases and conditions, a decrease in chronic uric acid levels towards, or preferably to, normal levels, would treat those conditions. The compositions and methods of the invention can also be used to treat asymptomatic hyperuricemia. Normalizing hyperuricemia prevents one or more of the comorbidities associated with hyperuricemia including, but not limited to, gout, NAFLD, NASH, metabolic disorder, insulin resistance, cardiovascular disease, hypertension, type 2 diabetes, and conditions linked to oxidative stress e.g., chronic low grade inflammation; or other XDH-associated disease. In some embodiments of the methods of the invention, the iRNA is administered to a subject such that the iRNA is delivered to a specific site within the subject. The inhibition of expression of XDH may be assessed using measurements of the level or change in the level of XDH mRNA or XDH protein in a sample derived from a specific site within the subject, e.g., the liver.

As used herein, the terms detecting or determining a level of an anlyte are understood to mean performing the steps to determine if a material, e.g., protein, RNA, is present. As used herein, methods of detecting or determining include detection or determination of an anlyte level that is below the level of detection for the method used.

VII. Methods of Treating or Preventing XDH-Associated Diseases

The present invention provides therapeutic and prophylactic methods which include administering to a subject having an XDH-associated disease, disorder, and/or condition, or prone to developing, an XDH-associated disease, disorder, and/or condition, compositions comprising an iRNA agent targeting an XDH gene. Non-limiting examples of XDH-associated diseases include, for example, gout, NAFLD, NASH, metabolic disorder, insulin resistance, cardiovascular disease, hypertension, type 2 diabetes, and conditions linked to oxidative stress e.g., chronic low grade inflammation.

The methods of the invention are useful for treating a subject having an XDH-associated disease, e.g., a subject that would benefit from reduction in XDH gene expression and/or XDH protein production.

In one aspect, the invention provides methods of preventing at least one sign or symptom in a subject susceptible to or having an XDH-associated disease, e.g., gout, NAFLD, NASH, metabolic disorder, insulin resistance, cardiovascular disease, hypertension, type 2 diabetes, and conditions linked to oxidative stress e.g., chronic low grade inflammation. The methods include administering to the subject a prohylactically effective amount of the iRNA agent, e.g. dsRNA, pharmaceutical compositions, or vectors of the invention, thereby preventing at least one sign or symptom in a subject having an XDH-associated disease.

In one embodiment, an iRNA agent targeting XDH is administered to a subject having an XDH-associated disease such that the expression of an XDH gene, e.g., in a cell, tissue, blood or other tissue or fluid of the subject are reduced by at least about 10%, 11%, 12%, 13%, 14%, 15%, 16%, 17%, 18%, 19%, 20%, 21%, 22%, 23%, 24%, 25%, 26%, 27%, 28%, 29%, 30%, 31%, 32%, 33%, 34%, 35%, 36%, 37%, 38%, 39%, 40%, 41%, 42%, 43%, 44%, 45%, 46%, 47%, 48%, 49%, 50%, 51%, 52%, 53%, 54%, 55%, 56%, 57%, 58%, 59%, 60%, 61%, 62%, 62%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, or at least about 99% or more, or to a level below the level of detection of the assay, when the dsRNA agent is administered to the subject.

The methods and uses of the invention include administering a composition described herein such that expression of the target XDH gene is decreased for an extended duration, e.g., at least one month, preferably at least three months.

Administration of the dsRNA according to the methods and uses of the invention may result in a reduction of the severity, signs, symptoms, and/or markers of such diseases or disorders in a patient with an XDH-associated disease. By "reduction" in this context is meant a statistically or clinically significant decrease in such level. The reduction can be, for example, at least about 5%, 10%, 15%, 20%, 25%, 30%, 35%, 40%, 45%, 50%, 55%, 60%, 65%, 70%, 75%, 80%, 85%, 90%, 95%, or about 100%.

Efficacy of treatment or prevention of disease can be assessed, for example by measuring disease progression, disease remission, symptom severity, reduction in pain, quality of life, dose of a medication required to sustain a treatment effect, level of a disease marker or any other measurable parameter appropriate for a given disease being treated or targeted for prevention. It is well within the ability of one skilled in the art to monitor efficacy of treatment or prevention by measuring any one of such parameters, or any combination of parameters. Comparison of the later readings with the initial readings, or historically relevant population controls, provide a physician an indication of whether the treatment is effective. It is well within the ability of one skilled in the art to monitor efficacy of treatment or prevention by measuring any one of such parameters, or any combination of parameters. In connection with the administration of an iRNA targeting an XDH gene or pharmaceutical composition thereof, "effective against" an XDH-associated disease indicates that administration in a clinically appropriate manner results in a beneficial effect for at least a statistically significant fraction of patients, such as improvement of symptoms, a cure, a reduction in disease, extension of life, improvement in quality of life, or other effect generally recognized as positive by medical doctors familiar with treating an XDH-associated disease and the related causes.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment. Efficacy for a given iRNA drug or formulation of that drug can also be judged using an experimental animal model for the given disease as known in the art. When using an experimental animal model, efficacy of treatment is evidenced when a statistically significant reduction in a marker or symptom is observed.

XDH expression may be inhibited, e.g., in a liver cell of a subject, by at least 20, 25, 30, 35, 40, 45, 50, 55, 60, 65, 70, 75, 80, 85, 90, or 95, or to a level below the level of detection of the assay. The methods of the invention do not require knockdown of expression in all cell types in which XDH is expressed.

The in vivo methods of the invention may include administering to a subject a composition containing an iRNA, where the iRNA includes a nucleotide sequence that is complementary to at least a part of an RNA transcript of the XDH gene of the mammal to be treated. When the organism to be treated is a mammal such as a human, the composition can be administered by any means known in the art including, but not limited to oral, intraperitoneal, or parenteral routes, including intravenous, intramuscular, subcutaneous, transdermal, airway (aerosol), nasal, rectal, and topical (including buccal and sublingual) administration. In certain embodiments, the compositions are administered by intravenous infusion or injection. In certain embodiments, the compositions are administered by subcutaneous injection.

In some embodiments, the administration is via a depot injection. A depot injection may release the iRNA in a consistent way over a prolonged time period. Thus, a depot injection may reduce the frequency of dosing needed to obtain a desired effect, e.g., a desired inhibition of XDH, or a therapeutic or prophylactic effect. A depot injection may also provide more consistent serum concentrations. Depot injections may include subcutaneous injections or intramuscular injections. In preferred embodiments, the depot injection is a subcutaneous injection.

In some embodiments, the administration is via a pump. The pump may be an external pump or a surgically implanted pump. In certain embodiments, the pump is a subcutaneously implanted osmotic pump. In other embodiments, the pump is an infusion pump. An infusion pump may be used for intravenous, subcutaneous, arterial, or epidural infusions. In preferred embodiments, the infusion pump is a subcutaneous infusion pump. In other embodiments, the pump is a surgically implanted pump that delivers the iRNA to the liver.

The mode of administration may be chosen based upon whether local or systemic treatment is desired and based upon the area to be treated. The route and site of administration may be chosen to enhance targeting.

In one aspect, the present invention also provides methods for inhibiting the expression of an XDH gene in a mammal. The methods include administering to the mammal a composition comprising an iRNA that targets an XDH gene in a cell of the mammal and maintaining the mammal for a time sufficient to obtain degradation of the mRNA transcript of the XDH gene, thereby inhibiting expression of the XDH gene in the cell. Reduction in gene expression can be assessed by any methods known it the art and by methods, e.g. qRT-PCR, described herein. Reduction in protein production can be assessed by any methods known it the art and by methods, e.g. ELISA, described herein. In one embodiment, a puncture liver biopsy sample serves as the tissue material for monitoring the reduction in the XDH gene or protein expression.

The present invention further provides methods of treatment of a subject in need thereof. The treatment methods of the invention include administering an iRNA of the invention to a subject, e.g., a subject that would benefit from a reduction or inhibition of XDH expression, in a therapeutically effective amount of an iRNA targeting an XDH gene or a pharmaceutical composition comprising an iRNA targeting an XDH gene.

An iRNA of the invention may be administered as a "free iRNA." A free iRNA is administered in the absence of a pharmaceutical composition. The naked iRNA may be in a suitable buffer solution. The buffer solution may comprise acetate, citrate, prolamine, carbonate, or phosphate, or any combination thereof. In one embodiment, the buffer solution is phosphate buffered saline (PBS). The pH and osmolarity of the buffer solution containing the iRNA can be adjusted such that it is suitable for administering to a subject.

Alternatively, an iRNA of the invention may be administered as a pharmaceutical composition, such as a dsRNA liposomal formulation.

Subjects that would benefit from a reduction or inhibition of XDH gene expression are those having hyperuricemia as demonstrated by a chronic uric acid level of at least 6.8 mg/dl. It is expected that normalizing hyperuricemia would prevent one or more of the comorbidities associated with hyperuricemia including, but not limited to, gout, NAFLD, NASH, metabolic disorder, insulin resistance, cardiovascular disease, hypertension, type 2 diabetes, and conditions linked to oxidative stress e.g., chronic low grade inflammation; or other XDH-associated disease.

A. Hyperuricemia

Serum uric acid levels are not routinely obtained as clinical lab values. However, hyperuricemia is associated with a number of diseases and conditions including, gout, NAFLD, NASH, metabolic disorder, insulin resistance, cardiovascular disease, hypertension, type 2 diabetes, and conditions linked to oxidative stress e.g., chronic low grade inflammation. Normalization of uric acid levels is useful in the prevention or treatment of one or more conditions associated with elevated serum uric acid levels. Further, a subject derives clinical benefit from normalization of serum uric acid levels towards or to a normal serum uric acid level, e.g., no more than 6.8 mg/dl, preferably no more than 6 mg/dl, even in the absence of overt signs or symptoms of one or more conditions associated with elevated uric acid, e.g., gout, NAFLD, NASH, metabolic disorder, insulin resistance, cardiovascular disease, hypertension, type 2 diabetes, or conditions linked to oxidative stress e.g., chronic low grade inflammation. Methods to detect and monitor uric acid in serum or other subject samples are known in the art. Uric acid levels can be detected, for example using carbonate-phosphotungstate method, spectrophotometric uricase method, or chromatotgraphy methods such as HPLC or LCMS.

Allopurinol is a xanthine oxidase inhibitor that is used to reduce serum uric acid levels for the treatment of a number of conditions, e.g., gout, cardiovascular disease including ischemia-reperfusion injury, hypertension, atherosclerosis, and stroke, and inflammatory diseases (Pacher et al., Pharma. Rev. 58:87-114, 2006). However, the use of allopurinol is contraindicated in subjects with impaired renal function, e.g., chronic kidney disease, hypothyroidism, hyperinsulinemia, or insulin resistance; or in subjects predisposed to kidney disease or impaired renal function, e.g., subjects with hypertension, metabolic disorder, diabetes, and the elderly. Further, allopurinol should not be taken by subjects taking oral coagulants or probencid as well as subjects taking diuretics, especially thiazide diuretics or other drugs that can reduce kidney function or have potential kidney toxicity.

In certain embodiments, the compositions and methods of the invention are for use in treatment of subjects with hyperuricemia and impaired renal function. For example, in certain embodiments, the compositions and methods of the invention are for use in subjects with hyperuricemia and chronic kidney disease. In certain embodiments, the compositions and methods are for use in subjects with hyperuricemia who are suffering from one or more of cardiovascular disease, metabolic disorder, insulin resistance, hyperinsulinemia, diabetes, hypothyroidism, or inflammatory disease; or elderly subjects (e.g., over 65). In certain embodiments, the compositions and methods are for use in subjects with hyperuricemia who are also taking a drug that can reduce kidney function as demonstrated by the drug label. For example, in certain embodiments the compositions and methods of the invention are for use in subjects with hyperuricemia who are being treated with oral coagulants or probencid. For example, in certain embodiments the compositions and methods of the invention are for use in subjects with hyperuricemia who are being treated with diuretics, especially thiazide diuretics.

In certain embodiments, the compositions and methods of the invention are used in combination with other compositions and methods to treat hyperuricemia, e.g., allopurinol, oxypurinol, febuxostat.

B. Gout

Gout affects approximately 1 in 40 adults, most commonly men between 30-60 years of age. Gout less commonly affects women. Gout is one of a few types of arthritis where future damage to joints can be avoided by treatment. Gout is characterized by recurrent attacks of acute inflammatory arthritis caused by an inflammatory reaction to uric acid crystals in the joint due to hyperuricemia resulting from insufficient renal clearance of uric acid or excessive uric acid production. Fructose associated gout is associated with variants of transporters expressed in the kidney, intestine, and liver. Gout is characterized by the formation and deposition of tophi, monosodium urate (MSU) crystals, in the joints and subcutaneously. Pain associated with gout is not related to the size of the tophi, but is a result of an immune response against the MSU crystals. There is a linear inverse relation between serum uric acid and the rate of decrease in tophus size. For example, in one study of 18 patients with non-tophaceous gout, serum uric acid declined to 2.7-5.4 mg/dL (0.16-0.32 mM) in all subjects within 3 months of starting urate lowering therapy (Pascual and Sivera, Ann. Rheum. Dis. 66:1056-1058). However, it took 12 months with normalized serum uric acid for MSU crystals to disappear from asymptomatic knee or first MTP joints in patients who had gout for less than 10 years, vs. 18 months in those with gout for more than 10 years. Therefore, effective treatment of gout does not require complete clearance of tophi or resolution of all symptoms, e.g., joint pain and swelling, inflammation, but simply a reduction in at least one sign or symptom of gout, e.g., reduction in severity or frequency of gout attacks, in conjunction with a reduction in serum urate levels.

Currently available treatments for gout are contraindicated or ineffective in a number of subjects. Allopurinol, a common first line treatment to reduce uric acid levels in subjects with gout, is contraindicated in a number of populations, especially those with compromised renal function, as discussed above. Further, a number of subjects fail treatment with allopurinol, e.g., subjects who suffer gout flares despite treatment, or subjects who suffer from rashes or hypersensitivity reactions associated with allopurinol.

In certain embodiments, the compositions and methods of the invention are for use in treatment of subjects with gout and impaired renal function. For example, in certain embodiments, the compositions and methods of the invention are for use in subjects with gout and chronic kidney disease. In certain embodiments, the compositions and methods are for use in subjects with gout who are suffering from one or more of cardiovascular disease, metabolic disorder, insulin resistance, hyperinsulinemia, diabetes, hypothyroidism, or inflammatory disease; or elderly subjects (e.g., over 65). In certain embodiments, the compositions and methods are for use in subjects with gout who are also taking a drug that can reduce kidney function as demonstrated by the drug label. For example, in certain embodiments the compositions and methods of the invention are for use in subjects with gout who are being treated with oral coagulants or probencid. For example, in certain embodiments the compositions and methods of the invention are for use in subjects with gout who are being treated with diuretics, especially thiazide diuretics. For example, in certain embodiments the compositions and methods of the invention are for use in subjects with gout who have failed treatment with allopurinol.

In certain embodiments, the compositions and methods of the invention are used in combination with other agents to reduce serum uric acid. In certain embodiments, the compositions and methods of the invention are used in combination with agents for treatment of symptoms of gout, e.g., analgesic or anti-inflammatory agents, e.g., NSAIDS.

C. NAFLD

NAFLD is associated with hyperuricemia (Xu et al., J. Hepatol. 62:1412-1419, 2015). The definition of nonalcoholic fatty liver disease (NAFLD) requires that (a) there is evidence of hepatic steatosis, either by imaging or by histology and (b) there are no causes for secondary hepatic fat accumulation such as significant alcohol consumption, use of steatogenic medication or hereditary disorders. In the majority of patients, NAFLD is associated with metabolic risk factors such as obesity, diabetes mellitus, and dyslipidemia. NAFLD is histologically further categorized into nonalcoholic fatty liver (NAFL) and nonalcoholic steatohepatitis (NASH). NAFL is defined as the presence of hepatic steatosis with no evidence of hepatocellular injury in the form of ballooning of the hepatocytes. NASH is defined as the presence of hepatic steatosis and inflammation with hepatocyte injury (ballooning) with or without fibrosis (Chalasani et al., Hepatol. 55:2005-2023, 2012). It is generally agreed that patients with simple steatosis have very slow, if any, histological progression, while patients with NASH can exhibit histological progression to cirrhotic-stage disease. The long term outcomes of patients with NAFLD and NASH have been reported in several studies. Their findings can be summarized as follows; (a) patients with NAFLD have increased overall mortality compared to matched control populations, (b) the most common cause of death in patients with NAFLD, NAFL, and NASH is cardiovascular disease, and (c) patients with NASH (but not NAFL) have an increased liver-related mortality rate. In a mouse model of NAFLD, treatment with allopurinol both prevented the development of hepatic steatosis, but also significantly ameliorated established hepatic steatosis in mice (Xu et al., J. Hepatol. 62:1412-1419, 2015).

As discussed above, treatment with allopurinol is contraindicated in a number of populations, especially those with compromised renal function.

In certain embodiments, the compositions and methods of the invention are for use in treatment of subjects with NAFLD and impaired renal function. For example, in certain embodiments, the compositions and methods of the invention are for use in subjects with NAFLD and chronic kidney disease. In certain embodiments, the compositions and methods are for use in subjects with NAFLD who are suffering from one or more of cardiovascular disease, metabolic disorder, insulin resistance, hyperinsulinemia, diabetes, hypothyroidism, or inflammatory disease; or elderly subjects (e.g., over 65). In certain embodiments, the compositions and methods are for use in subjects with NAFLD who are also taking a drug that can reduce kidney function as demonstrated by the drug label. For example, in certain embodiments the compositions and methods of the invention are for use in subjects with NAFLD who are being treated with oral coagulants or probencid. For example, in certain embodiments the compositions and methods of the invention are for use in subjects with NAFLD who are being treated with diuretics, especially thiazide diuretics. For example, in certain embodiments the compositions and methods of the invention are for use in subjects with NAFLD who have failed treatment with allopurinol.

In certain embodiments, the compositions and methods of the invention are used in combination with other agents to reduce serum uric acid. In certain embodiments, the compositions and methods of the invention are used in combination with agents for treatment of symptoms of NAFLD.

D. Cardiovascular disease

Cardiovascular disease has been associated with hyperuricemia. Allopurinol has been demonstrated to be effective in the treatment of cardiovascular disease in animal models and humans including myocardial infarction, ischemia-reperfusion injury, hypoxia, ischemic heart disease, heart failure, hypercholesterolemia, and hypertension (Pacher et al., Pharma. Rev. 58:87-114, 2006). As discussed above, treatment with allopurinol is contraindicated in a number of populations, especially those with compromised renal function.

In certain embodiments, the compositions and methods of the invention are for use in treatment of subjects with cardiovascular disease and impaired renal function. For example, in certain embodiments, the compositions and methods of the invention are for use in subjects with cardiovascular disease and chronic kidney disease. In certain embodiments, the compositions and methods are for use in subjects with cardiovascular disease who are suffering from one or more of metabolic disorder, insulin resistance, hyperinsulinemia, diabetes, hypothyroidism, or inflammatory disease. In certain embodiments, the compositions and methods are for use in subjects with cardiovascular disease who are also taking a drug that can reduce kidney function as demonstrated by the drug label. For example, in certain embodiments the compositions and methods of the invention are for use in subjects with cardiovascular disease who are being treated with oral coagulants or probencid. For example, in certain embodiments the compositions and methods of the invention are for use in subjects with cardiovascular disease who are being treated with diuretics, especially thiazide diuretics. For example, in certain embodiments the compositions and methods of the invention are for use in subjects with cardiovascular disease who have failed treatment with allopurinol.

In certain embodiments, the compositions and methods of the invention are used in combination with other agents to reduce serum uric acid. In certain embodiments, the compositions and methods of the invention are used in combination with agents for treatment of symptoms of cardiovascular disease, e.g., agents to decrease blood pressure, e.g., diuretics, beta-blockers, ACE inhibitors, angiotensin II receptor blockers, calcium channel blockers, alpha blockers, alpha-2 receptor antagonists, combined alpha- and beta-blockers, central agonists, peripheral adrenergic inhibitors, and blood vessel dialators; or agents to decrease cholesterol, e.g., statins, selective cholesterol absorption inhibitors, resins, or lipid lowering therapies.

E. Metabolic Syndrome, Insulin Resistance, and Type 2 Diabetes

Metabolic syndrome, insulin resistance, and type 2 diabetes are associated with hyperuricemia (Cardoso et al., *J. Pediatr.* 89:412-418, 2013).

Metabolic syndrome is characterized by a cluster of conditions defined as at least three of the five following metabolic risk factors:
1. Large waistline (≥35 inches for women or ≥40 inches for men);
2. High triglyceride level (≥150 mg/dl);
3. Low HDL cholesterol (≤50 mg/dl for women or ≤40 mg/dl for men);
4. Elevated blood pressure (≥130/85) or on medicine to treat high blood pressure; and
5. High fasting blood sugar (≥100 mg/dl) or being in medicine to treat high blood sugar.

Insulin resistance is characterized by the presence of at least one of:
1. A fasting blood glucose level of 100-125 mg/dL taken at two different times; or
2. An oral glucose tolerance test with a result of a glucose level of 140-199 mg/dL at 2 hours after glucose consumption.

Type 2 diabetes is characterized by at least one of:
1. A fasting blood glucose level ≥126 mg/dL taken at two different times;
2. A hemoglobin A1c (A1C) test with a result of ≥6.5% or higher; or
3. An oral glucose tolerance test with a result of a glucose level ≥200 mg/dL at 2 hours after glucose consumption.

Metabolic syndrome, insulin resistance, and type 2 diabetes are often associated with decreased renal function or the potential for decreased renal function.

In certain embodiments, the compositions and methods of the invention are for use in treatment of subjects with metabolic syndrome, insulin resistance, or type 2 diabetes and impaired renal function. For example, in certain embodiments, the compositions and methods of the invention are for use in subjects with metabolic syndrome, insulin resistance, or type 2 diabetes and chronic kidney disease. In certain embodiments, the compositions and methods are for use in subjects with metabolic syndrome, insulin resistance, or type 2 diabetes who are suffering from one or more of cardiovascular disease, hypothyroidism, or inflammatory disease; or elderly subjects (e.g., over 65). In certain embodiments, the compositions and methods are for use in subjects with metabolic syndrome, insulin resistance, or type 2 diabetes who are also taking a drug that can reduce kidney function as demonstrated by the drug label. For example, in certain embodiments the compositions and methods of the invention are for use in subjects with metabolic syndrome, insulin resistance, or type 2 diabetes who are being treated with oral coagulants or probencid. For example, in certain embodiments the compositions and methods of the invention are for use in subjects with metabolic syndrome, insulin resistance, or type 2 diabetes who are being treated with diuretics, especially thiazide diuretics.

In certain embodiments, the compositions and methods of the invention are used in combination with other agents to reduce serum uric acid. In certain embodiments, the compositions and methods of the invention are used in combination with agents for treatment of symptoms of metabolic syndrome, insulin resistance, or type 2 diabetes. In certain embodiments, subjects are treated with e.g., agents to decrease blood pressure, e.g., diuretics, beta-blockers, ACE inhibitors, angiotensin II receptor blockers, calcium channel blockers, alpha blockers, alpha-2 receptor antagonists, combined alpha- and beta-blockers, central agonists, peripheral adrenergic inhibitors, and blood vessel dialators; agents to decrease cholesterol, e.g., statins, selective cholesterol absorption inhibitors, resins, or lipid lowering therapies; or agents to normalize blood sugar, e.g., metformin, sulfonylureas, meglitinides, thiazolidinediones, DPP-4 inhibitors, GLP-1 receptor antagonists, and SGLT2 inhibitors.

The iRNA and additional therapeutic agents may be administered at the same time or in the same combination, e.g., parenterally, or the additional therapeutic agent can be administered as part of a separate composition or at separate times or by another method known in the art or described herein.

In one embodiment, the method includes administering a composition featured herein such that expression of the target XDH gene is decreased in at least one tissue, e.g., in liver, such as for about 1, 2, 3, 4, 5, 6, 7, 8, 12, 16, 18, 24 hours, 28, 32, or about 36 hours. In one embodiment, expression of the target XDH gene is decreased for an extended duration, e.g., at least about two, three, four days or more, e.g., about one week, two weeks, three weeks, or four weeks or longer, in at least one tissue, e.g., liver.

Preferably, the iRNAs useful for the methods and compositions featured herein specifically target RNAs (primary or processed) of the target XDH gene. Compositions and methods for inhibiting the expression of these genes using iRNAs can be prepared and performed as described herein.

Administration of the iRNA according to the methods of the invention may result in a reduction of the severity, signs, symptoms, or markers of such diseases or disorders in a patient with a disorder of elevated serum uric acid. By "reduction" in this context is meant a statistically significant decrease in such level. The reduction can be, for example, at least about 20%, 25%, 30%, 35%, 40%, 45%, 50%, 55%, 60%, 65%, 70%, 75%, 80%, 85%, 90%, or 95%, or to below the level of detection of the assay used. For certain measures, a reduction of a marker to the lowest possible level may not be desirable. For example, as used herein, reduction includes a lowering towards or to a normal serum uric acid level in the subject. For example, reduction includes lowering towards or preferably to 6.8 mg/dl or less of serum uric acid. In certain embodiments, reduction includes lowering to 6 mg/dl or less of serum uric acid. Typically, a serum uric acid level of at least 2 mg/dl is preferred. Similarly, triglyceride levels are preferably lowered (i.e., normalized) to less than 150 mg/dl and fasting blood sugar is lowered (i.e., normalized) to less than 100 mg/dl. Such considerations are well understood by those of skill in the art.

Efficacy of treatment or prevention of disease can be assessed, for example by measuring disease progression, disease remission, symptom severity, reduction in pain, quality of life, dose of a medication required to sustain a treatment effect, level of a disease marker, or any other measurable parameter appropriate for a given disease being treated or targeted for prevention. It is well within the ability of one skilled in the art to monitor efficacy of treatment or prevention by measuring any one of such parameters, or any combination of parameters. For example, efficacy of treatment of an XDH related disorder. Diagnostic criteria for a number of XDH related disorders are provided above. The exact criteria for treatment or prevention will depend on the disease or condition present in the subject or the disease or condition to which the subject is susceptible. Treatment and prevention typically include normalization or maintenance of normal clinical laboratory values.

Comparisons of the later readings with the initial readings provide a physician an indication of whether the treatment is effective. It is well within the ability of one skilled in the art to monitor efficacy of treatment or prevention by measuring any one of such parameters, or any combination of parameters. In connection with the administration of an iRNA targeting XDH or pharmaceutical composition thereof, "effective against" an XDH related disorder indicates that administration in a clinically appropriate manner results in a beneficial effect for at least a statistically significant fraction of patients, such as a improvement of symptoms, a cure, a reduction in disease, extension of life, improvement in quality of life, or other effect generally recognized as positive by medical doctors familiar with treating XDH-related disorders.

A treatment or preventive effect is evident when there is a statistically significant improvement in one or more parameters of disease status, or by a failure to worsen or to develop symptoms where they would otherwise be anticipated. As an example, a favorable change of at least 10% in a measurable parameter of disease, and preferably at least 20%, 30%, 40%, 50% or more can be indicative of effective treatment, e.g., normalization of a clinical laboratory value. Efficacy for a given iRNA drug or formulation of that drug can also be judged using an experimental animal model for the given disease as known in the art. When using an experimental animal model, efficacy of treatment is evidenced when a statistically significant reduction in a marker or symptom is observed.

Alternatively, the efficacy can be measured by a reduction in the severity of disease as determined by one skilled in the art of diagnosis based on a clinically accepted disease severity grading scale. Any positive change resulting in e.g., lessening of severity of disease measured using the appropriate scale, represents adequate treatment using an iRNA or iRNA formulation as described herein.

Subjects can be administered a therapeutic amount of iRNA, such as about 0.01 mg/kg to about 200 mg/kg.

The iRNA can be administered by intravenous infusion over a period of time, on a regular basis. In certain embodiments, after an initial treatment regimen, the treatments can be administered on a less frequent basis. Administration of the iRNA can reduce XDH levels, e.g., in at least one of a cell, tissue, blood, urine, or other compartment of the patient by at least about 20%, 25%, 30%, 35%, 40%, 45%, 50%, 55%, 60%, 65%, 70%, 75%, 80%, 85%, 90%, or 95%, or below the level of detection of the assay method used.

Before administration of a full dose of the iRNA, patients can be administered a smaller dose, such as a 5% infusion reaction, and monitored for adverse effects, such as an allergic reaction. In another example, the patient can be monitored for unwanted immunostimulatory effects, such as increased cytokine (e.g., TNF-alpha or INF-alpha) levels.

Alternatively, the iRNA can be administered subcutaneously, i.e., by subcutaneous injection. One or more injections may be used to deliver the desired daily dose of iRNA to a subject. The injections may be repeated over a period of time. The administration may be repeated on a regular basis. In certain embodiments, after an initial treatment regimen, the treatments can be administered on a less frequent basis. A repeat-dose regimen may include administration of a therapeutic amount of iRNA on a regular basis, such as every other day or to once a year. In certain embodiments, the iRNA is administered about once per month to about once per quarter (i.e., about once every three months).

IX. Cell Type XDH Expression

XDH is expressed predominantly in the liver and intestine, However, adipocytes and other extrahepatic tissues express XDH and thus can contribute significant amounts of uric acid in the body. As a result, silencing XDH mRNA in obese patients with high BMI may result in less uric acid lowering than in lean patients. Additionally, silencing XDH mRNA in the liver may be insufficient to lower urate levels given extrahepatic XDH expression. In patients with reduced, but not complete, urinary uric acid excretion, silencing liver XDH mRNA may be insufficient to reduce urate burden from poor renal clearance (defects such as SLC2A9, ABCG2 etc.) Therefore, the efficacy of the iRNA compounds of the invention to prevent or treat an XDH-associated condition, and the amount required for an effective dose, may depend, at least in part, on the amount of fat present in the subject rather than the overall size of the subject. Therefore, in certain embodiments, the compositions and methods of the invention are not for treatment or not for treatment as a single agent in subjects who are obese, i.e., a body mass index (BMI) ≥30.0 wherein BMI is a person's weight in kilograms divided by the square of height in meters. A high BMI can be an indicator of high body fatness.

This invention is further illustrated by the following examples which should not be construed as limiting. The entire contents of all references, patents and published patent applications cited throughout this application, as well as the Sequence Listing, are hereby incorporated herein by reference.

EXAMPLES

Example 1. iRNA Synthesis

Source of Reagents

Where the source of a reagent is not specifically given herein, such reagent can be obtained from any supplier of reagents for molecular biology at a quality/purity standard for application in molecular biology.

Transcripts
siRNA Design

A set of siRNAs targeting the human XDH "xanthine dehydrogenase" gene (human: NCBI refseqID NM_000379; NCBI GeneID: 7498), as well as toxicology-species XDH orthologs (cynomolgus monkey: XM_005576184; mouse: NM_011723; rat, NM_017154) were designed using custom R and Python scripts. The human NM_000379 REFSEQ mRNA, version 3, has a length of 5717 bases. The rationale and method for the set of siRNA designs is as follows: the predicted efficacy for every potential 19mer siRNA from position 80 through position 5717 (the coding region and 3' UTR) was determined with a linear model derived the direct measure of mRNA knockdown from more than 20,000 distinct siRNA designs targeting a large number of vertebrate genes. Subsets of the XDH siRNAs were designed with perfect or near-perfect matches between human, cynomolgus and rhesus monkey. A further subset was designed with perfect or near-perfect matches to mouse and rat XDH orthologs. For each strand of the siRNA, a custom Python script was used in a brute force search to measure the number and positions of mismatches between the siRNA and all potential alignments in the target species transcriptome. Extra weight was given to mismatches in the seed region, defined here as positions 2-9 of the antisense oligonucleotide, as well the cleavage site of the siRNA, defined here as positions 10-11 of the antisense oligonucleotide. The relative weight of the mismatches was 2.8; 1.2:1 for seed mismatches, cleavage site, and other positions up through antisense position 19. Mismatches in the first position were ignored. A specificity score was calculated for each strand by summing the value of each weighted mismatch. Preference was given to siRNAs whose antisense score in human and cynomolgus monkey was >=2.0 and predicted efficacy was >=50% knockdown of the XDH transcript.

siRNA Synthesis

XDH siRNA sequences are synthesized at 1 umol scale on Mermade 192 synthesizer (BioAutomation) using the solid support mediated phosphoramidite chemistry. The solid support is controlled pore glass (500° A) loaded with custom GalNAc ligand or universal solid support (AM biochemical). Ancillary synthesis reagents, 2'-F and 2'-O-Methyl RNA and deoxy phosphoramidites are obtained from Thermo-Fisher (Milwaukee, Wis.) and Hongene (China). 2'F, 2'-O-Methyl, RNA, DNA and other modified nucleosides are introduced in the sequences using the corresponding phosphoramidites. Synthesis of 3' GalNAc conjugated single strands is performed on a GalNAc modified CPG support. Custom CPG universal solid support is used for the synthesis of antisense single strands. Coupling time for all phosphoramidites (100 mM in acetonitrile) is 5 min employing 5-Ethylthio-1H-tetrazole (ETT) as activator (0.6 M in acetonitrile). Phosphorothioate linkages are generated using a 50 mM solution of 3-((Dimethylamino-methylidene) amino)-3H-1, 2, 4-dithiazole-3-thione (DDTT, obtained from Chemgenes (Wilmington, Mass., USA) in anhydrous acetonitrile/pyridine (1:1 v/v). Oxidation time is 3 minutes. All sequences are synthesized with final removal of the DMT group ("DMT off").

Upon completion of the solid phase synthesis, oligoribonucleotides are cleaved from the solid support and deprotected in sealed 96 deep well plates using 200 µL Aqueous Methylamine reagent at 60° C. for 20 minutes. For sequences containing 2' ribo residues (2'-OH) that are protected with tert-butyl dimethyl silyl (TBDMS) group, a second step deprotection is performed using TEA.3HF (triethylamine trihydro fluoride) reagent. To the methylamine deprotection solution, 200 uL of dimethyl sulfoxide (DMSO) and 300 ul TEA.3HF reagent is added and the solution was incubated for additional 20 min at 60° C. At the end of cleavage and deprotection step, the synthesis plate is allowed to come to room temperature and is precipitated by addition of 1 mL of acetontile: ethanol mixture (9:1). The plates are cooled at −80° C. for 2 hrs and the superanatant decanted carefully with the aid of a multi channel pipette. The oligonucleotide pellet is re-suspended in 20 mM NaOAc buffer and desalted using a 5 mL HiTrap size exclusion column (GE Healthcare) on an AKTA Purifier System equipped with an A905 autosampler and a Frac 950 fraction collector. Desalted samples are collected in 96 well plates. Samples from each sequence are analyzed by LC-MS to confirm the identity, UV (260 nm) for quantification and a selected set of samples by IEX chromatography to determine purity.

Annealing of XDH single strands is performed on a Tecan liquid handling robot. Equimolar mixture of sense and antisense single strands are combined and annealed in 96 well plates. After combining the complementary single strands, the 96 well plate is sealed tightly and heated in an oven at 100° C. for 10 minutes and allowed to come slowly to room temperature over a period 2-3 hours. The concentration of each duplex is normalized to 10 uM in 1×PBS and then submitted for in vitro screening assays.

A detailed list of the unmodified XDH sense and antisense strand sequences is shown in Table 3 and a detailed list of the modified XDH sense and antisense strand sequences is shown in Table 4.

Example 2—In Vitro Screening—Primary Mouse Hepatocytes and Primary Cyno Hepatocytes Cell Culture and Transfections:

Primary Mouse Hepatocytes (PMH) (GIBCO) and Primary Cyno Hepatocytes (PCH) (Celsis) were transfected by adding 4.9 µl of Opti-MEM plus 0.1 µl of Lipofectamine RNAiMax per well (Invitrogen, Carlsbad Calif. cat #13778-150) to 5 µl of siRNA duplexes per well into a 384-well plate and incubated at room temperature for 15 minutes. Forty µl of William's E Medium (Life Tech) containing about $5 \times 10^3$ cells were then added to the siRNA mixture. Cells were incubated for 24 hours prior to RNA purification. Single dose experiments were performed at 10 nM and 0.1 nM.

Total RNA Isolation Using DYNABEADS mRNA Isolation Kit:

RNA was isolated using an automated protocol on a BioTek-EL406 platform using DYNABEADs (Invitrogen, cat #61012). Briefly, 50 µl of Lysis/Binding Buffer and 25 µl of lysis buffer containing 3 µl of magnetic beads were added to the plate with cells. Plates were incubated on an electromagnetic shaker for 10 minutes at room temperature and then magnetic beads were captured and the supernatant was removed. Bead-bound RNA was then washed 2 times with 150 µl Wash Buffer A and once with Wash Buffer B. Beads were then washed with 150 µl Elution Buffer, re-captured and the supernatant was removed.

cDNA Synthesis Using ABI High Capacity cDNA Reverse Transcription Kit (Applied Biosystems, Foster City, Calif., Cat #4368813):

Ten µl of a master mix containing 1 µl 10× Buffer, 0.4 µl 25× dNTPs, 1 µl 10× Random primers, 0.5 µl Reverse Transcriptase, 0.5 µl RNase inhibitor and 6.6 µl of $H_2O$ per reaction was added to RNA isolated above. Plates were sealed, mixed, and incubated on an electromagnetic shaker for 10 minutes at room temperature, followed by 2 hours at 37° C. Plates are then incubated at 81° C. for 8 minutes.

Real Time PCR:

Two μl of cDNA were added to a master mix containing 0.5 μl of GAPDH TaqMan Probe (Hs99999905 m1), 0.5 μl XDH probe and 5 μl Lightcycler 480 probe master mix (Roche Cat #04887301001) per well in a 384 well plates (Roche cat #04887301001). Real time PCR was performed in a LightCycler480 Real Time PCR system (Roche). Each duplex was assayed at least two times and data were normalized to cells transfected with a non-targeting control siRNA.

To calculate relative fold change, real time data was analyzed using the ΔΔCt method and normalized to assays performed with cells transfected with 10 nM AD-1955, a non-targeting control siRNA.

The sense and antisense sequences of AD-1955 are:

```
SENSE:
                                        (SEQ ID NO: 17)
cuuAcGcuGAGuAcuucGAdTsdT;

ANTISENSE:
                                        (SEQ ID NO: 18)
UCGAAGuACUcAGCGuAAGdTsdT.
```

Table 5 shows the results of a single dose screen in Primary Cynomolgus Hepatocytes and Primary Mouse Hepatocytes transfected with the indicated modified iRNAs.

TABLE 2

Abbreviations of nucleotide monomers used in nucleic acid sequence representation. It will be understood that these monomers, when present in an oligonucleotide, are mutually linked by 5'-3'- phosphodiester bonds.

| Abbreviation | Nucleotide(s) |
|---|---|
| A | Adenosine-3'-phosphate |
| Af | 2'-fluoroadenosine-3'-phosphate |
| Afs | 2'-fluoroadenosine-3'-phosphorothioate |
| As | adenosine-3'-phosphorothioate |

TABLE 2-continued

Abbreviations of nucleotide monomers used in nucleic acid sequence representation. It will be understood that these monomers, when present in an oligonucleotide, are mutually linked by 5'-3'- phosphodiester bonds.

| Abbreviation | Nucleotide(s) |
|---|---|
| C | cytidine-3'-phosphate |
| Cf | 2'-fluorocytidine-3'-phosphate |
| Cfs | 2'-fluorocytidine-3'-phosphorothioate |
| Cs | cytidine-3'-phosphorothioate |
| G | guanosine-3'-phosphate |
| Gf | 2'-fluoroguanosine-3'-phosphate |
| Gfs | 2'-fluoroguanosine-3'-phosphorothioate |
| Gs | guanosine-3'-phosphorothioate |
| T | 5'-methyluridine-3'-phosphate |
| Tf | 2'-fluoro-5-methyluridine-3'-phosphate |
| Tfs | 2'-fluoro-5-methyluridine-3'-phosphorothioate |
| Ts | 5-methyluridine-3'-phosphorothioate |
| U | Uridine-3'-phosphate |
| Uf | 2'-fluorouridine-3'-phosphate |
| Ufs | 2'-fluorouridine-3'-phosphorothioate |
| Us | uridine-3'-phosphorothioate |
| N | any nucleotide (G, A, C, T or U) |
| a | 2'-O-methyladenosine-3'-phosphate |
| as | 2'-O-methyladenosine-3'-phosphorothioate |
| c | 2'-O-methylcytidine-3'-phosphate |
| cs | 2'-O-methylcytidine-3'-phosphorothioate |
| g | 2'-O-methylguanosine-3'-phosphate |
| gs | 2'-O-methylguanosine-3'-phosphorothioate |
| t | 2'-O-methyl-5-methyluridine-3'-phosphate |
| ts | 2'-O-methyl-5-methyluridine-3'-phosphorothioate |
| u | 2'-O-methyluridine-3'-phosphate |
| us | 2'-O-methyluridine-3'-phosphorothioate |
| s | phosphorothioate linkage |
| L96 | N-[tris(GalNAc-alkyl)-amidodecanoyl)]-4-hydroxyprolinol Hyp-(GalNAc-alkyl)3 |
| dT | 2`-deoxythymidine-3`-phosphate |
| dC | 2`-deoxycytidine-3`-phosphate |
| Y44 | inverted abasic DNA(2-hydroxymethyl-tetrahydrofurane-5-phosphate) |
| (Tgn) | Thymidine-glycol nucleic acid (GNA) S-Isomer |
| P | Phosphate |
| VP | Vinyl-phosphate |
| (Aam) | 2'-O-(N-methylacetamide)adenosine-3'-phosphate |

TABLE 3

Unmodified Sense and Antisense Strand Sequences of XDH dsRNAs

| Duplex Name | Sense Oligo Name | Sense Sequence (5' to 3') | SEQ ID NO | Position in NM_000379.3 | Antisense Oligo Name | Antisense Sequence (5' to 3') | SEQ ID NO | Position in NM_000379.3 |
|---|---|---|---|---|---|---|---|---|
| AD-70003 | A-140499 | AACUGUGGAAG GAAUAGGAAA | 19 | 339-358_G21A | A-140500 | UUUCCUAUUCCU UCCACAGUUGU | 105 | 337-358_G21A |
| AD-70049 | A-140591 | AACUGUGGAAG GAAUAGGAAA | 20 | 339-358_G21A | A-140592 | UUUCCUAUUCCU UCCACAGUUGU | 106 | 337-358_G21A |
| AD-69981 | A-140455 | GAGGAGAUUGA GAAUGCCUUA | 21 | 490-509_C21A | A-140456 | UAAGGCAUUCUC AAUCUCCUCCA | 107 | 488-509_C21A |
| AD-70027 | A-140547 | GAGGAGAUUGA GAAUGCCUUA | 22 | 490-509_C21A | A-140548 | UAAGGCAUUCUC AAUCUCCUCCA | 108 | 488-509_C21A |
| AD-69970 | A-140433 | GAGAUUGAGAA UGCCUUCCAA | 23 | 493-512 | A-140434 | UUGGAAGGCAUU CUCAAUCUCCU | 109 | 491-512 |
| AD-70016 | A-140525 | GAGAUUGAGAA UGCCUUCCAA | 24 | 493-512 | A-140526 | UUGGAAGGCAUU CUCAAUCUCCU | 110 | 491-512 |
| AD-70007 | A-140507 | GUUCAAGAAUA UGCUGUUUCA | 25 | 888-907_C21A | A-140508 | UGAAACAGCAUA UUCUUGAACUU | 111 | 886-907_C21A |

TABLE 3-continued

Unmodified Sense and Antisense Strand Sequences of XDH dsRNAs

| Duplex Name | Sense Oligo Name | Sense Sequence (5' to 3') | SEQ ID NO | Position in NM_000379.3 | Antisense Oligo Name | Antisense Sequence (5' to 3') | SEQ ID NO | Position in NM_000379.3 |
|---|---|---|---|---|---|---|---|---|
| AD-70053 | A-140599 | GUUCAAGAAUA UGCUGUUUCA | 26 | 888-907_C21A | A-140600 | UGAAACAGCAUA UUCUUGAACUU | 112 | 886-907_C21A |
| AD-69995 | A-140483 | AAAAGACAGAG GUGUUCAGAA | 27 | 1046-1065_G21A | A-140484 | UUCUGAACACCU CUGUCUUUUGG | 113 | 1044-1065_G21A |
| AD-70041 | A-140575 | AAAAGACAGAG GUGUUCAGAA | 28 | 1046-1065_G21A | A-140576 | UUCUGAACACCU CUGUCUUUUGG | 114 | 1044-1065_G21A |
| AD-69973 | A-140439 | AAAGACAGAGG UGUUCAGAGA | 29 | 1047-1066_G21A | A-140440 | UCUCUGAACACC UCUGUCUUUUG | 115 | 1045-1066_G21A |
| AD-70019 | A-140531 | AAAGACAGAGG UGUUCAGAGA | 30 | 1047-1066_G21A | A-140532 | UCUCUGAACACC UCUGUCUUUUG | 116 | 1045-1066_G21A |
| AD-69975 | A-140443 | CGGAGAGAAGA UGACAUUGCA | 31 | 1357-1376_C21A | A-140444 | UGCAAUGUCAUC UUCUCUCCGGG | 117 | 1355-1376_C21A |
| AD-70021 | A-140535 | CGGAGAGAAGA UGACAUUGCA | 32 | 1357-1376_C21A | A-140536 | UGCAAUGUCAUC UUCUCUCCGGG | 118 | 1355-1376_C21A |
| AD-69983 | A-140459 | AGAGAAGAUGA CAUUGCCAAA | 33 | 1360-1379_G21A | A-140460 | UUUGGCAAUGUC AUCUUCUCUCC | 119 | 1358-1379_G21A |
| AD-70029 | A-140551 | AGAGAAGAUGA CAUUGCCAAA | 34 | 1360-1379_G21A | A-140552 | UUUGGCAAUGUC AUCUUCUCUCC | 120 | 1358-1379_G21A |
| AD-69986 | A-140465 | GAAGAUGACAU UGCCAAGGUA | 35 | 1363-1382 | A-140466 | UACCUUGGCAAU GUCAUCUUCUC | 121 | 1361-1382 |
| AD-70032 | A-140557 | GAAGAUGACAU UGCCAAGGUA | 36 | 1363-1382 | A-140558 | UACCUUGGCAAU GUCAUCUUCUC | 122 | 1361-1382 |
| AD-69976 | A-140445 | CAGUCUGAGGA GGACAUGGUA | 37 | 1783-1802_G21A | A-140446 | UACCAUGUCCUC CUCAGACUGAC | 123 | 1781-1802_G21A |
| AD-70022 | A-140537 | CAGUCUGAGGA GGACAUGGUA | 38 | 1783-1802_G21A | A-140538 | UACCAUGUCCUC CUCAGACUGAC | 124 | 1781-1802_G21A |
| AD-69987 | A-140467 | AAGGAUAAGGU UACUUGUGUU | 39 | 2053-2072 | A-140468 | AACACAAGUAAC CUUAUCCUUCG | 125 | 2051-2072 |
| AD-70033 | A-140559 | AAGGAUAAGGU UACUUGUGUU | 40 | 2053-2072 | A-140560 | AACACAAGUAAC CUUAUCCUUCG | 126 | 2051-2072 |
| AD-69990 | A-140473 | AGGAUAAGGUU ACUUGUGUUA | 41 | 2054-2073_G21A | A-140474 | UAACACAAGUAA CCUUAUCCUUC | 127 | 2052-2073_G21A |
| AD-70036 | A-140565 | AGGAUAAGGUU ACUUGUGUUA | 42 | 2054-2073_G21A | A-140566 | UAACACAAGUAA CCUUAUCCUUC | 128 | 2052-2073_G21A |
| AD-69989 | A-140471 | CAUAUCAUUGG UGCUGUGGUU | 43 | 2077-2096 | A-140472 | AACCACAGCACC AAUGAUAUGCC | 129 | 2075-2096 |
| AD-70035 | A-140563 | CAUAUCAUUGG UGCUGUGGUU | 44 | 2077-2096 | A-140564 | AACCACAGCACC AAUGAUAUGCC | 130 | 2075-2096 |
| AD-69988 | A-140469 | GUGAAAAUCAC CUAUGAAGAA | 45 | 2137-2156 | A-140470 | UUCUUCAUAGGU GAUUUUCACCC | 131 | 2135-2156 |
| AD-70034 | A-140561 | GUGAAAAUCAC CUAUGAAGAA | 46 | 2137-2156 | A-140562 | UUCUUCAUAGGU GAUUUUCACCC | 132 | 2135-2156 |
| AD-69996 | A-140485 | ACAAUUGAGGA UGCUAUAAAA | 47 | 2173-2192_G21A | A-140486 | UUUUAUAGCAUC CUCAAUUGUGA | 133 | 2171-2192_G21A |
| AD-70042 | A-140577 | ACAAUUGAGGA UGCUAUAAAA | 48 | 2173-2192_G21A | A-140578 | UUUUAUAGCAUC CUCAAUUGUGA | 134 | 2171-2192_G21A |
| AD-69977 | A-140447 | UGCUAUAAAGA ACAACUCCUU | 49 | 2184-2203 | A-140448 | AAGGAGUUGUUC UUUAUAGCAUC | 135 | 2182-2203 |

TABLE 3-continued

Unmodified Sense and Antisense Strand Sequences of XDH dsRNAs

| Duplex Name | Sense Oligo Name | Sense Sequence (5' to 3') | SEQ ID NO | Position in NM_000379.3 | Antisense Oligo Name | Antisense Sequence (5' to 3') | SEQ ID NO | Position in NM_000379.3 |
|---|---|---|---|---|---|---|---|---|
| AD-70023 | A-140539 | UGCUAUAAAGA ACAACUCCUU | 50 | 2184-2203 | A-140540 | AAGGAGUUGUUC UUUAUAGCAUC | 136 | 2182-2203 |
| AD-69978 | A-140449 | GCUAUAAAGAA CAACUCCUUU | 51 | 2185-2204 | A-140450 | AAAGGAGUUGUU CUUUAUAGCAU | 137 | 2183-2204 |
| AD-70024 | A-140541 | GCUAUAAAGAA CAACUCCUUU | 52 | 2185-2204 | A-140542 | AAAGGAGUUGUU CUUUAUAGCAU | 138 | 2183-2204 |
| AD-69972 | A-140437 | UAUAAGAACA ACUCCUUUUA | 53 | 2187-2206 | A-140438 | UAAAGGAGUUG UUCUUUAUAGC | 139 | 2185-2206 |
| AD-70018 | A-140529 | UAUAAGAACA ACUCCUUUUA | 54 | 2187-2206 | A-140530 | UAAAGGAGUUG UUCUUUAUAGC | 140 | 2185-2206 |
| AD-69971 | A-140435 | UAAAGAACAAC UCCUUUUAUA | 55 | 2189-2208_G21A | A-140436 | UAUAAAGGAGU UGUUCUUUAUA | 141 | 2187-2208_G21A |
| AD-70017 | A-140527 | UAAAGAACAAC UCCUUUUAUA | 56 | 2189-2208_G21A | A-140528 | UAUAAAGGAGU UGUUCUUUAUA | 142 | 2187-2208_G21A |
| AD-69994 | A-140481 | GACAUGCUGAU AACUGGUGGA | 57 | 2578-2597_C21A | A-140482 | UCCACCAGUUAU CAGCAUGUCCU | 143 | 2576-2597_C21A |
| AD-70040 | A-140573 | GACAUGCUGAU AACUGGUGGA | 58 | 2578-2597_C21A | A-140574 | UCCACCAGUUAU CAGCAUGUCCU | 144 | 2576-2597_C21A |
| AD-69985 | A-140463 | AUGCUGAUAAC UGGUGGCAGA | 59 | 2581-2600 | A-140464 | UCUGCCACCAGU UAUCAGCAUGU | 145 | 2579-2600 |
| AD-70031 | A-140555 | AUGCUGAUAAC UGGUGGCAGA | 60 | 2581-2600 | A-140556 | UCUGCCACCAGU UAUCAGCAUGU | 146 | 2579-2600 |
| AD-69982 | A-140457 | UGAUAACUGGU GGCAGACAUA | 61 | 2585-2604_C21A | A-140458 | UAUGUCUGCCAC CAGUUAUCAGC | 147 | 2583-2604_C21A |
| AD-70028 | A-140549 | UGAUAACUGGU GGCAGACAUA | 62 | 2585-2604_C21A | A-140550 | UAUGUCUGCCAC CAGUUAUCAGC | 148 | 2583-2604_C21A |
| AD-69984 | A-140461 | UACAAGGUUGG CUUCAUGAAA | 63 | 2620-2639_G21A | A-140462 | UUUCAUGAAGCC AACCUUGUAUC | 149 | 2618-2639_G21A |
| AD-70030 | A-140553 | UACAAGGUUGG CUUCAUGAAA | 64 | 2620-2639_G21A | A-140554 | UUUCAUGAAGCC AACCUUGUAUC | 150 | 2618-2639_G21A |
| AD-69991 | A-140475 | ACAAGGUUGGC UUCAUGAAGA | 65 | 2621-2640 | A-140476 | UCUUCAUGAAGC CAACCUUGUAU | 151 | 2619-2640 |
| AD-70037 | A-140567 | ACAAGGUUGGC UUCAUGAAGA | 66 | 2621-2640 | A-140568 | UCUUCAUGAAGC CAACCUUGUAU | 152 | 2619-2640 |
| AD-70005 | A-140503 | AAGCUUGAGGG UUUCACCUUA | 67 | 2956-2975_G21A | A-140504 | UAAGGUGAAACC CUCAAGCUUCU | 153 | 2954-2975_G21A |
| AD-70051 | A-140595 | AAGCUUGAGGG UUUCACCUUA | 68 | 2956-2975_G21A | A-140596 | UAAGGUGAAACC CUCAAGCUUCU | 154 | 2954-2975_G21A |
| AD-70002 | A-140497 | AAGAGUGAGGU UGACAAGUUA | 69 | 3025-3044_C21A | A-140498 | UAACUUGUCAAC CUCACUCUUCC | 155 | 3023-3044_C21A |
| AD-70048 | A-140589 | AAGAGUGAGGU UGACAAGUUA | 70 | 3025-3044_C21A | A-140590 | UAACUUGUCAAC CUCACUCUUCC | 156 | 3023-3044_C21A |
| AD-69992 | A-140477 | GUUCAACAAGG AGAAUUGUUA | 71 | 3042-3061_G21A | A-140478 | UAACAAUUCUCC UUGUUGAACUU | 157 | 3040-3061_G21A |
| AD-70038 | A-140569 | GUUCAACAAGG AGAAUUGUUA | 72 | 3042-3061_G21A | A-140570 | UAACAAUUCUCC UUGUUGAACUU | 158 | 3040-3061_G21A |
| AD-69993 | A-140479 | ACAAGGAGAAU UGUUGGAAAA | 73 | 3047-3066 | A-140480 | UUUUCCAACAAU UCUCCUUGUUG | 159 | 3045-3066 |

TABLE 3-continued

Unmodified Sense and Antisense Strand Sequences of XDH dsRNAs

| Duplex Name | Sense Oligo Name | Sense Sequence (5' to 3') | SEQ ID NO | Position in NM_000379.3 | Antisense Oligo Name | Antisense Sequence (5' to 3') | SEQ ID NO | Position in NM_000379.3 |
|---|---|---|---|---|---|---|---|---|
| AD-70039 | A-140571 | ACAAGGAGAAU UGUUGGAAAA | 74 | 3047-3066 | A-140572 | UUUUCCAACAAU UCUCCUUGUUG | 160 | 3045-3066 |
| AD-69980 | A-140453 | ACCAAGUUUGG AAUAAGCUUU | 75 | 3091-3110 | A-140454 | AAAGCUUAUUCC AAACUUGGUGG | 161 | 3089-3110 |
| AD-70026 | A-140545 | ACCAAGUUUGG AAUAAGCUUU | 76 | 3091-3110 | A-140546 | AAAGCUUAUUCC AAACUUGGUGG | 162 | 3089-3110 |
| AD-69979 | A-140451 | UAUCUUCUUUG CCAUCAAAGA | 77 | 3891-3910 | A-140452 | UCUUUGAUGGCA AGAAGAUAGA | 163 | 3889-3910 |
| AD-70025 | A-140543 | UAUCUUCUUUG CCAUCAAAGA | 78 | 3891-3910 | A-140544 | UCUUUGAUGGCA AGAAGAUAGA | 164 | 3889-3910 |
| AD-69974 | A-140441 | UCUUCUUUGCC AUCAAAGAUA | 79 | 3893-3912_G21A | A-140442 | UAUCUUUGAUGG CAAAGAAGAUA | 165 | 3891-3912_G21A |
| AD-70020 | A-140533 | UCUUCUUUGCC AUCAAAGAUA | 80 | 3893-3912_G21A | A-140534 | UAUCUUUGAUGG CAAAGAAGAUA | 166 | 3891-3912_G21A |
| AD-70004 | A-140501 | CAGAACAUGGA UCUAUUAAAA | 81 | 4152-4171_G21A | A-140502 | UUUUAAUAGAUC CAUGUUCUGUG | 167 | 4150-4171_G21A |
| AD-70050 | A-140593 | CAGAACAUGGA UCUAUUAAAA | 82 | 4152-4171_G21A | A-140594 | UUUUAAUAGAUC CAUGUUCUGUG | 168 | 4150-4171_G21A |
| AD-70009 | A-140511 | ACAAUGAUAAG CAAAUUCAAA | 83 | 4266-4285 | A-140512 | UUUGAAUUUGCU UAUCAUUGUGU | 169 | 4264-4285 |
| AD-70055 | A-140603 | ACAAUGAUAAG CAAAUUCAAA | 84 | 4266-4285 | A-140604 | UUUGAAUUUGCU UAUCAUUGUGU | 170 | 4264-4285 |
| AD-69998 | A-140489 | AAUGGUGAAUA UGCAAUUAGA | 85 | 4300-4319_G21A | A-140490 | UCUAAUUGCAUA UUCACCAUUUA | 171 | 4298-4319_G21A |
| AD-70044 | A-140581 | AAUGGUGAAUA UGCAAUUAGA | 86 | 4300-4319_G21A | A-140582 | UCUAAUUGCAUA UUCACCAUUUA | 172 | 4298-4319_G21A |
| AD-70006 | A-140505 | ACCAUGAACA GCAAAGCAUA | 87 | 4519-4538 | A-140506 | UAUGCUUUGCUG UUCAUGGUUU | 173 | 4517-4538 |
| AD-70052 | A-140597 | ACCAUGAACA GCAAAGCAUA | 88 | 4519-4538 | A-140598 | UAUGCUUUGCUG UUCAUGGUUU | 174 | 4517-4538 |
| AD-70001 | A-140495 | CCAUCUUUGAA UCAUUGGAAA | 89 | 4599-4618 | A-140496 | UUUCCAAUGAUU CAAAGAUGGUU | 175 | 4597-4618 |
| AD-70047 | A-140587 | CCAUCUUUGAA UCAUUGGAAA | 90 | 4599-4618 | A-140588 | UUUCCAAUGAUU CAAAGAUGGUU | 176 | 4597-4618 |
| AD-69997 | A-140487 | AAGAAUAAAGA AUGAAACAAA | 91 | 4618-4637 | A-140488 | UUUGUUUCAUUC UUUAUUCUUUC | 177 | 4616-4637 |
| AD-70043 | A-140579 | AAGAAUAAAGA AUGAAACAAA | 92 | 4618-4637 | A-140580 | UUUGUUUCAUUC UUUAUUCUUUC | 178 | 4616-4637 |
| AD-69999 | A-140491 | AAUAAGAAUG AAACAAAUUA | 93 | 4621-4640_C21A | A-140492 | UAAUUUGUUUCA UUCUUUAUUCU | 179 | 4619-4640_C21A |
| AD-70045 | A-140583 | AAUAAGAAUG AAACAAAUUA | 94 | 4621-4640_C21A | A-140584 | UAAUUUGUUUCA UUCUUUAUUCU | 180 | 4619-4640_C21A |
| AD-70008 | A-140509 | AUCCAACCAAC UCAAUUAUUA | 95 | 4703-4722_G21A | A-140510 | UAAUAAUUGAGU UGGUUGGAUUU | 181 | 4701-4722_G21A |
| AD-70054 | A-140601 | AUCCAACCAAC UCAAUUAUUA | 96 | 4703-4722_G21A | A-140602 | UAAUAAUUGAGU UGGUUGGAUUU | 182 | 4701-4722_G21A |
| AD-70000 | A-140493 | CACUGUAUAAA UCCAACCUUA | 97 | 5599-5618_C21A | A-140494 | UAAGGUUGGAUU UAUACAGUGAA | 183 | 5597-5618_C21A |

TABLE 3-continued

Unmodified Sense and Antisense Strand Sequences of XDH dsRNAs

| Duplex Name | Sense Oligo Name | Sense Sequence (5' to 3') | SEQ ID NO | Position in NM_000379.3 | Antisense Oligo Name | Antisense Sequence (5' to 3') | SEQ ID NO | Position in NM_000379.3 |
|---|---|---|---|---|---|---|---|---|
| AD-70046 | A-140585 | CACUGUAUAAA UCCAACCUUA | 98 | 5599-5618_C21A | A-140586 | UAAGGUUGGAUU UAUACAGUGAA | 184 | 5597-5618_C21A |
| AD-70015 | A-140523 | AACUGUGGAAG GCAUAGGAAA | 99 | 337-356 | A-140524 | UUUCCUAUGCCU UCCACAGUUGU | 185 | 335-356 |
| AD-70012 | A-140517 | GGAUUUCAAAC CUUUAGAUCA | 100 | 673-692_C21A | A-140518 | UGAUCUAAAGGU UUGAAAUCCUC | 186 | 671-692_C21A |
| AD-70014 | A-140521 | ACAGAGAUAGG CAUUGAAAUA | 101 | 860-879_G21A | A-140522 | UAUUUCAAUUCC UAUCUCUGUGU | 187 | 858-879_G21A |
| AD-70010 | A-140513 | GGCAUUGAAAU GAAAUUUAAA | 102 | 869-888 | A-140514 | UUUAAAUUUCAU UUCAAUGCCUA | 188 | 867-888 |
| AD-70013 | A-140519 | ACAAUCCAGGA UGCUAUAAAA | 103 | 2168-2187_G21A | A-140520 | UUUUAUAGCAUC CUGGAUUGUGA | 189 | 2166-2187_G21A |
| AD-70011 | A-140515 | CAAGAUGGAAG UGGAGAAAUU | 104 | 3019-3038 | A-140516 | AAUUUCUCCACU UCCAUCUUGCG | 190 | 3017-3038 |

TABLE 4

XDH Modified Sequences

| Duplex Name | Sense Oligo Name | Sense Sequence (5' to 3') | SEQ ID NO | Start in NM_000379.3 | Antisense Oligo Name | Antisense Sequence (5' to 3') | SEQ ID NO | Start in NM_000379.3 |
|---|---|---|---|---|---|---|---|---|
| AD-70003 | A-140499 | AACUGUGGAAGGAAU AGGAAAdTdT | 191 | 339 | A-140500 | UUUCCUAUUCCUUCCAC AGUUGdTdT | 277 | 337 |
| AD-70049 | A-140591 | asascuguGfgAfAf Gfgaauaggaaal96 | 192 | 339 | A-140592 | usUfsuccUfaUfUfcc uuCfcAfcaguusgsu | 278 | 337 |
| AD-69981 | A-140455 | GAGGAGAUUGAGAAU GCCUUAdTdT | 193 | 490 | A-140456 | UAAGGCAUUCUCAAUCU CCUCCAdTdT | 279 | 488 |
| AD-70027 | A-140547 | gsasggagAfuUfGfAf Afgaaugccuual96 | 194 | 490 | A-140548 | usAfsaggCfaUfUfcu caAfuCfuccucscsa | 280 | 488 |
| AD-69970 | A-140433 | GAGAUUGAGAAUGCC UUCCAAdTdT | 195 | 493 | A-140434 | UUGGAAGGCAUUCUCAA UCUCCUdTdT | 281 | 491 |
| AD-70016 | A-140525 | gsasgauuGfaGfAfAf AfugccuuccaaL96 | 196 | 493 | A-140526 | usUfsggaAfgGfCfau ucUfcAfaucucscsu | 282 | 491 |
| AD-70007 | A-140507 | GUUCAAGAAUAUGCU GUUUCAdTdT | 197 | 888 | A-140508 | UGAAACAGCAUAUUCUU GAACUUdTdT | 283 | 886 |
| AD-70053 | A-140599 | gsusucaaGfaAfUfUf AfugcuguuucaL96 | 198 | 888 | A-140600 | usGfsaaaCfaGfCfau auUfcUfugaacsusu | 284 | 886 |
| AD-69995 | A-140483 | AAAAGACAGAGGUGU UCAGAAdTdT | 199 | 1046 | A-140484 | UUCUGAACACCUCUGUC UUUUGdTdT | 285 | 1044 |
| AD-70041 | A-140575 | asasaagaCfaGfAfGf Gfuguucagaal96 | 200 | 1046 | A-140576 | usUfscugAfaCfAfcc ucUfgUfcuuuusgsg | 286 | 1044 |
| AD-69973 | A-140439 | AAAGACAGAGGUGUU CAGAGAdTdT | 201 | 1047 | A-140440 | UCUCUGAACACCUCUGU CUUUUGdTdT | 287 | 1045 |
| AD-70019 | A-140531 | asasagacAfgAfGfGf Gfuguucagagal96 | 202 | 1047 | A-140532 | usCfsucuGfaAfCfac cuCfuGfucuuusug | 288 | 1045 |
| AD-69975 | A-140443 | CGGAGAAGAUGACAU UGCAdTdT | 203 | 1357 | A-140444 | UGCAAUGUCAUCUUCUC UCCGGGdTdT | 289 | 1355 |
| AD-70021 | A-140535 | csgsgagaGfaAfGfAf ugacauugcaL96 | 204 | 1357 | A-140536 | usGfscaaUfgUfCfau cuUfcUfcuccgsgsg | 290 | 1355 |

TABLE 4-continued

XDH Modified Sequences

| Duplex Name | Sense Oligo Name | Sense Sequence (5' to 3') | SEQ ID NO | Start in NM_000379.3 | Antisense Oligo Name | Antisense Sequence (5' to 3') | SEQ ID NO | Start in NM_000379.3 |
|---|---|---|---|---|---|---|---|---|
| AD-69983 | A-140459 | AGAGAAGAUGACAUU GCCAAAdTdT | 205 | 1360 | A-140460 | UUUGGCAAUGUCAUCUU CUCUCCdTdT | 291 | 1358 |
| AD-70029 | A-140551 | asgsagaaGfaUfGf Afcauugccaaa L96 | 206 | 1360 | A-140552 | usUfsuggCfaAfUfgu caUfcUfucucuscsc | 292 | 1358 |
| AD-69986 | A-140465 | GAAGAUGACAUUGCC AAGGUAdTdT | 207 | 1363 | A-140466 | UACCUUGGCAAUGUCAU CUUCUCdTdT | 293 | 1361 |
| AD-70032 | A-140557 | gsasagauGfaCfAf UfugccaagguaL96 | 208 | 1363 | A-140558 | usAfsccuUfgGfCfaa ugUfcAfucuucsusc | 294 | 1361 |
| AD-69976 | A-140445 | CAGUCUGAGGAGGAC AUGGUAdTdT | 209 | 1783 | A-140446 | UACCAUGUCCUCCUCAG ACUGAdTdT | 295 | 1781 |
| AD-70022 | A-140537 | csasgucuGfaGfGf AfggacaugguaL96 | 210 | 1783 | A-140538 | usAfsccaUfgUfCfcu ccUfcAfgacugsasc | 296 | 1781 |
| AD-69987 | A-140467 | AAGGAUAAGGUUACU UGUGUUdTdT | 211 | 2053 | A-140468 | AACACAAGUAACCUUAU CCUUCGdTdT | 297 | 2051 |
| AD-70033 | A-140559 | asasggauAfaGfGf UfuacuuguguuL96 | 212 | 2053 | A-140560 | asAfscacAfaGfUfaa ccUfuAfuccuuscsg | 298 | 2051 |
| AD-69990 | A-140473 | AGGAUAAGGUUACUU GUGUUAdTdT | 213 | 2054 | A-140474 | UAACACAAGUAACCUUA UCCUUCdTdT | 299 | 2052 |
| AD-70036 | A-140565 | asgsgauaAfgGfUf UfacuuguguuaL96 | 214 | 2054 | A-140566 | usAfsacaCfaAfGfua acCfuUfauccususc | 300 | 2052 |
| AD-69989 | A-140471 | CAUAUCAUUGGUGCU GUGGUUdTdT | 215 | 2077 | A-140472 | AACCACAGCACCAAUGA UAUGCCdTdT | 301 | 2075 |
| AD-70035 | A-140563 | csasuaucAfuUfGf GfugcugugguuL96 | 216 | 2077 | A-140564 | asAfsccaCfaGfCfac caAfuGfauaugscsc | 302 | 2075 |
| AD-69988 | A-140469 | GUGAAAAUCACCUAU GAAGAAdTdT | 217 | 2137 | A-140470 | UUCUUCAUAGGUGAUUU UCACCCdTdT | 303 | 2135 |
| AD-70034 | A-140561 | gsusgaaaAfuCfAf CfcuaugaagaaL96 | 218 | 2137 | A-140562 | usUfscuuCfaUfAfgg ugAfuUfuucacscsc | 304 | 2135 |
| AD-69996 | A-140485 | ACAAUUGAGGAUGCU AUAAAAdTdT | 219 | 2173 | A-140486 | UUUUAUAGCAUCCUCAA UUGUGAdTdT | 305 | 2171 |
| AD-70042 | A-140577 | ascsaauuGfaGfGf AfugcuauaaaaL96 | 220 | 2173 | A-140578 | usUfsuuaUfaGfCfau ccUfcAfauugusgsa | 306 | 2171 |
| AD-69977 | A-140447 | UGCUAUAAAGAACAA CUCCUUdTdT | 221 | 2184 | A-140448 | AAGGAGUUGUUCUUUAU AGCAUCdTdT | 307 | 2182 |
| AD-70023 | A-140539 | usgscuauAfaAfGf AfacaacuccuuL96 | 222 | 2184 | A-140540 | asAfsggaGfuUfGfuu cuUfuAfuagcasusc | 308 | 2182 |
| AD-69978 | A-140449 | GCUAUAAAGAACAAC UCCUUUdTdT | 223 | 2185 | A-140450 | AAAGGAGUUGUUCUUUA UAGCAUdTdT | 309 | 2183 |
| AD-70024 | A-140541 | gscsuauaAfaAfGf AfacaacuccuuuL96 | 224 | 2185 | A-140542 | asAfsaggAfgUfUfgu ucUfuUfauagcsasu | 310 | 2183 |
| AD-69972 | A-140437 | UAUAAAGAACAACUC CUUUUAdTdT | 225 | 2187 | A-140438 | UAAAAGGAGUUGUUCUU UAUAGCdTdT | 311 | 2185 |
| AD-70018 | A-140529 | usasuaaaGfaAfCf AfacuccuuuuaL96 | 226 | 2187 | A-140530 | usAfsaaaGfgAfGfuu guUfcUfuuauasgsc | 312 | 2185 |
| AD-69971 | A-140435 | UAAAGAACAACUCCU UUUUAdTdT | 227 | 2189 | A-140436 | UAUAAAGGAGUUGUUC UUUUAdTdT | 313 | 2187 |
| AD-70017 | A-140527 | usasaagaAfcAfAf CfuccuuuuauaL96 | 228 | 2189 | A-140528 | usAfsuaaAfaGfGfag uuGfuUfcuuuasusa | 314 | 2187 |

TABLE 4-continued

XDH Modified Sequences

| Duplex Name | Sense Oligo Name | Sense Sequence (5' to 3') | SEQ ID NO | Start in NM_ 000379.3 | Antisense Oligo Name | Antisense Sequence (5' to 3') | SEQ ID NO | Start in NM_ 000379.3 |
|---|---|---|---|---|---|---|---|---|
| AD-69994 | A-140481 | GACAUGCUGAUAACU GGUGGAdTdT | 229 | 2578 | A-140482 | UCCACCAGUUAUCAGCA UGUCCUdTdT | 315 | 2576 |
| AD-70040 | A-140573 | gsascaugCfuGfAf UfaacugguggaL96 | 230 | 2578 | A-140574 | usCfscacCfaGfUfua ucAfgCfaugucscsu | 316 | 2576 |
| AD-69985 | A-140463 | AUGCUGAUAACUGGU GGCAGAdTdT | 231 | 2581 | A-140464 | UCUGCCACCAGUUAUCA GCAUGUdTdT | 317 | 2579 |
| AD-70031 | A-140555 | asusgcugAfuAfAf CfuggugggcagaL96 | 232 | 2581 | A-140556 | usCfsugcCfaCfCfag uuAfuCfagcausgsu | 318 | 2579 |
| AD-69982 | A-140457 | UGAUAACUGGUGGCA GACAUAdTdT | 233 | 2585 | A-140458 | UAUGUCUGCCACCAGUU AUCAGCdTdT | 319 | 2583 |
| AD-70028 | A-140549 | usgsauaaCfuGfGf UfggcagacauaL96 | 234 | 2585 | A-140550 | usAfsuguCfuGfCfca ccAfgUfuaucasgsc | 320 | 2583 |
| AD-69984 | A-140461 | UACAAGGUUGGCUUC AUGAAAdTdT | 235 | 2620 | A-140462 | UUUCAUGAAGCCAACCU UGUAUCdTdT | 321 | 2618 |
| AD-70030 | A-140553 | usascaagGfuUfGf GfcuucaugaaaL96 | 236 | 2620 | A-140554 | usUfsucaUfgAfAfgc caAfcCfuugasusc | 322 | 2618 |
| AD-69991 | A-140475 | ACAAGGUUGGCUUCA UGAAGAdTdT | 237 | 2621 | A-140476 | UCUUCAUGAAGCCAACC UUGUAUdTdT | 323 | 2619 |
| AD-70037 | A-140567 | ascsaaggUfuGfGf CfuucaugaagaL96 | 238 | 2621 | A-140568 | usCfsuucAfuGfAfag ccAfaCfcuugusasu | 324 | 2619 |
| AD-70005 | A-140503 | AAGCUUGAGGGUUUC ACCUUAdTdT | 239 | 2956 | A-140504 | UAAGGUGAAACCCUCAA GCUUCUdTdT | 325 | 2954 |
| AD-70051 | A-140595 | asasgcuuGfaGfGf GfuuucaccuuaL96 | 240 | 2956 | A-140596 | usAfsaggUfgAfAfac ccUfcAfagcuuscsu | 326 | 2954 |
| AD-70002 | A-140497 | AAGAGUGAGGUUGAC AAGUUAdTdT | 241 | 3025 | A-140498 | UAACUUGUCAACCUCAC UCUUCCdTdT | 327 | 3023 |
| AD-70048 | A-140589 | asasgagUfgaGfGf UfugacaaguuaL96 | 242 | 3025 | A-140590 | usAfsacuUfgUfCfaa ccUfcAfcucuuscsc | 328 | 3023 |
| AD-69992 | A-140477 | GUUCAACAAGGAGAA UUGUUAdTdT | 243 | 3042 | A-140478 | UAACAAUUCUCCUUGUU GAACUUdTdT | 329 | 3040 |
| AD-70038 | A-140569 | gsusucaaCfaAfGf GfagaauuguuaL96 | 244 | 3042 | A-140570 | usAfsacaAfuUfCfuc cuUfgUfugaacsusu | 330 | 3040 |
| AD-69993 | A-140479 | ACAAGGAGAAUUGUU GGAAAAdTdT | 245 | 3047 | A-140480 | UUUUCCAACAAUUCUCC UUGUUGdTdT | 331 | 3045 |
| AD-70039 | A-140571 | ascsaaggAfgAfAf UfuguuggaaaaL96 | 246 | 3047 | A-140572 | usUfsuucCfaAfCfaa uuCfuCfcuugususg | 332 | 3045 |
| AD-69980 | A-140453 | ACCAAGUUUGGAAUA AGCUUUdTdT | 247 | 3091 | A-140454 | AAAGCUUAUUCCAAACU UGGUGGdTdT | 333 | 3089 |
| AD-70026 | A-140545 | ascscaagUfuUfGf GfaauaagcuuuL96 | 248 | 3091 | A-140546 | asAfsagcUfuAfUfuc caAfaCfuuggusgsg | 334 | 3089 |
| AD-69979 | A-140451 | UAUCUUCUUUGCCAU CAAAGAdTdT | 249 | 3891 | A-140452 | UCUUUGAUGGCAAAGAA GAUAGAdTdT | 335 | 3889 |
| AD-70025 | A-140543 | usasucuuCfuUfUf GfccaucaaagaL96 | 250 | 3891 | A-140544 | usCfsuuuGfaUfGfgc aaAfgAfagauasgsa | 336 | 3889 |
| AD-69974 | A-140441 | UCUUCUUUGCCAUCA AAGAUAdTdT | 251 | 3893 | A-140442 | UAUCUUUGAUGGCAAAG AAGAUAdTdT | 337 | 3891 |
| AD-70020 | A-140533 | uscsuucuUfuGfCf CfaucaaagauaL96 | 252 | 3893 | A-140534 | usAfsucuUfuGfAfug gcAfaAfgaagasusa | 338 | 3891 |

TABLE 4-continued

XDH Modified Sequences

| Duplex Name | Sense Oligo Name | Sense Sequence (5' to 3') | SEQ ID NO | Start in NM_ 000379.3 | Antisense Oligo Name | Antisense Sequence (5' to 3') | SEQ ID NO | Start in NM_ 000379.3 |
|---|---|---|---|---|---|---|---|---|
| AD-70004 | A-140501 | CAGAACAUGGAUCUA UUAAAAdTdT | 253 | 4152 | A-140502 | UUUUAAUAGAUCCAUGU UCUGUGdTdT | 339 | 4150 |
| AD-70050 | A-140593 | csasgaacAfuGfGf AfucuauuaaaaL96 | 254 | 4152 | A-140594 | usUfsuuaAfuAfGfau ccAfuGfuucugsusg | 340 | 4150 |
| AD-70009 | A-140511 | ACAAUGAUAAGCAAA UUCAAAdTdT | 255 | 4266 | A-140512 | UUUGAAUUGCUUAUCA UUGUGdTdT | 341 | 4264 |
| AD-70055 | A-140603 | ascsaaugAfuAfAf GfcaaauucaaaL96 | 256 | 4266 | A-140604 | usUfsugaAfuUfUfgc uuAfuCfauugusgsu | 342 | 4264 |
| AD-69998 | A-140489 | AAUGGUGAAUAUGCA AUUAGAdTdT | 257 | 4300 | A-140490 | UCUAAUUGCAUAUUCAC CAUUUAdTdT | 343 | 4298 |
| AD-70044 | A-140581 | asasugguGfaAfUf AfugcaauuagaL96 | 258 | 4300 | A-140582 | usCfsuaaUfUfGfCfau auUfcAfccauususa | 344 | 4298 |
| AD-70006 | A-140505 | ACCAAUGAACAGCAA AGCAUAdTdT | 259 | 4519 | A-140506 | UAUGCUUUGCUGUUCAU UGGUUUdTdT | 345 | 4517 |
| AD-70052 | A-140597 | ascscaauGfaAfCf AfgcaaagcauaL96 | 260 | 4519 | A-140598 | usAfsugcUfuUfGfcu guUfcAfuuggususu | 346 | 4517 |
| AD-70001 | A-140495 | CCAUCUUUGAAUCAU UGGAAAdTdT | 261 | 4599 | A-140496 | UUUCCAAUGAUUCAAAG AUGGUUdTdT | 347 | 4597 |
| AD-70047 | A-140587 | cscsaucuUfuGfAf AfucauuggaaaL96 | 262 | 4599 | A-140588 | usUfsuccAfaUfGfau ucAfaAfgauggsusu | 348 | 4597 |
| AD-69997 | A-140487 | AAGAAUAAAGAAUGA AACAAAdTdT | 263 | 4618 | A-140488 | UUUGUUUCAUUCUUUAU UCUUUCdTdT | 349 | 4616 |
| AD-70043 | A-140579 | asasgaauAfaAfGf AfaugaaacaaaL96 | 264 | 4618 | A-140580 | usUfsuguUfuCfAfuu cuUfuAfuucuususc | 350 | 4616 |
| AD-69999 | A-140491 | AAUAAAGAAUGAAAC AAAUUAdTdT | 265 | 4621 | A-140492 | UAAUUGUUUCAUUCUU UAUUCUdTdT | 351 | 4619 |
| AD-70045 | A-140583 | asasuaaaGfaAfUf GfaaacaaauuaL96 | 266 | 4621 | A-140584 | usAfsauuUfgUfUfuc auUfcUfuuauuscsu | 352 | 4619 |
| AD-70008 | A-140509 | AUCCAACCAACUCAA UUAUUAdTdT | 267 | 4703 | A-140510 | UAAUAAUUGAGUUGGUU GGAUUUdTdT | 353 | 4701 |
| AD-70054 | A-140601 | asusccaaCfcAfAf CfucaauuauuaL96 | 268 | 4703 | A-140602 | usAfsauaAfuUfGfag uuGfgUfuggaususu | 354 | 4701 |
| AD-70000 | A-140493 | CACUGUAUAAAUCCA ACCUUAdTdT | 269 | 5599 | A-140494 | UAAGGUUGGAUUUAUAC AGUGAAdTdT | 355 | 5597 |
| AD-70046 | A-140585 | csascuguAfuAfAf AfuccaaccuuaL96 | 270 | 5599 | A-140586 | usAfsaggUfuGfGfau uuAfuAfcagugsasa | 356 | 5597 |
| AD-70015 | A-140523 | AACUGUGGAAGGCAU AGGAAAdTdT | 271 | 337 | A-140524 | UUUCCUAUGCCUUCCAC AGUUGdTdT | 357 | 335 |
| AD-70012 | A-140517 | GGAUUUCAAACCUUU AGAUCAdTdT | 272 | 673 | A-140518 | UGAUCUAAAGGUUGAA AUCCUCdTdT | 358 | 671 |
| AD-70014 | A-140521 | ACAGAGAUAGGCAUU GAAAUAdTdT | 273 | 860 | A-140522 | UAUUUCAAUGCCUAUCU CUGUGdTdT | 359 | 858 |
| AD-70010 | A-140513 | GGCAUUGAAAUGAAA UUUAAAdTdT | 274 | 869 | A-140514 | UUUAAAUUUCAUUUCAA UGCCUAdTdT | 360 | 867 |
| AD-70013 | A-140519 | ACAAUCCAGGAUGCU AUAAAAdTdT | 275 | 2168 | A-140520 | UUUUAUAGCAUCCUGGA UUGUGdTdT | 361 | 2166 |
| AD-70011 | A-140515 | CAAGAUGGAAGUGGA GAAAUUdTdT | 276 | 3019 | A-140516 | AAUUUCUCCACUUCCAU CUUGCGdTdT | 362 | 3017 |

TABLE 5

Single dose screen in Primary Cynomolgus Hepatocytes and Primary Mouse Hepatocytes

| Duplex ID | Primary Cynomolgus Hepatocytes | | | | Primary Mouse Hepatocytes | | | |
|---|---|---|---|---|---|---|---|---|
| | 10 nM Avg | 10 nM SD | 0.1 nM Avg | 0.1 nM SD | 10 nM Avg | 10 nM SD | 0.1 nM Avg | 0.1 nM SD |
| AD-70016 | 34.3 | 6.9 | 41.7 | 5.2 | 4.5 | 0.6 | 38.1 | 3.4 |
| AD-70017 | 65.5 | 5.0 | 66.2 | 4.2 | 8.0 | 2.5 | 73.6 | 7.1 |
| AD-70018 | 36.3 | 0.9 | 74.9 | 18.3 | 5.9 | 1.1 | 49.6 | 6.7 |
| AD-70019 | 59.4 | 9.2 | 62.9 | 13.3 | 19.8 | 0.5 | 123.9 | 18.8 |
| AD-70020 | 40.5 | 7.0 | 38.9 | 6.6 | 10.7 | 0.8 | 122.7 | 24.0 |
| AD-70021 | 41.0 | 2.1 | 72.5 | 7.6 | 13.7 | 1.5 | 88.1 | 5.8 |
| AD-70022 | 44.8 | 5.9 | 49.7 | 19.0 | 17.3 | 2.3 | 105.7 | 7.6 |
| AD-70023 | 37.2 | 9.0 | 71.7 | 11.0 | 5.6 | 1.7 | 30.6 | 5.9 |
| AD-70024 | 61.0 | 10.5 | 86.4 | 9.3 | 7.2 | 0.6 | 32.6 | 4.0 |
| AD-70025 | 40.9 | 9.2 | 80.1 | 9.1 | 35.3 | 3.8 | 109.3 | 4.9 |
| AD-70026 | 41.1 | 5.7 | 54.1 | 8.1 | 7.3 | 1.1 | 57.8 | 4.8 |
| AD-70027 | 39.0 | 5.5 | 57.9 | 7.2 | 11.8 | 1.6 | 102.4 | 18.8 |
| AD-70028 | 47.1 | 2.6 | 55.1 | 15.9 | 11.0 | 2.2 | 95.9 | 17.2 |
| AD-70029 | 41.5 | 7.5 | 62.7 | 9.8 | 8.3 | 2.0 | 63.5 | 11.2 |
| AD-70030 | 42.4 | 5.9 | 45.2 | 11.0 | 16.6 | 1.8 | 101.1 | 7.5 |
| AD-70031 | 52.4 | 2.2 | 67.8 | 20.1 | 38.0 | 4.6 | 99.5 | 11.6 |
| AD-70032 | 51.1 | 6.0 | 74.3 | 14.9 | 22.4 | 9.9 | 100.9 | 12.8 |
| AD-70033 | 19.6 | 6.7 | 45.7 | 7.5 | 6.2 | 0.8 | 27.2 | 6.9 |
| AD-70034 | 39.0 | 9.1 | 88.9 | 22.1 | 16.2 | 3.8 | 89.2 | 6.2 |
| AD-70035 | 37.4 | 16.3 | 84.0 | 6.5 | 16.1 | 1.7 | 96.5 | 7.7 |
| AD-70036 | 53.0 | 5.9 | 61.3 | 11.3 | 49.8 | 7.1 | 105.9 | 8.4 |
| AD-70037 | 46.3 | 9.1 | 102.4 | 23.5 | 17.1 | 3.5 | 97.7 | 12.5 |
| AD-70038 | 49.0 | 3.6 | 54.3 | 17.6 | 86.4 | 5.3 | 95.6 | 11.5 |
| AD-70039 | 56.3 | 10.5 | 85.4 | 11.4 | 75.0 | 5.8 | 101.6 | 10.3 |
| AD-70040 | 52.8 | 3.5 | 101.1 | 17.9 | 95.9 | 5.1 | 96.2 | 11.1 |
| AD-70041 | 66.5 | 20.5 | 85.7 | 12.1 | 48.7 | 3.0 | 97.7 | 5.3 |
| AD-70042 | 34.8 | 4.6 | 47.2 | 4.2 | 20.3 | 1.1 | 106.8 | 11.1 |
| AD-70043 | 42.0 | 4.7 | 85.8 | 22.5 | 117.6 | 19.4 | 113.4 | 24.1 |
| AD-70044 | 37.5 | 9.6 | 47.1 | 22.7 | 87.4 | 13.6 | 111.6 | 16.7 |
| AD-70045 | 50.9 | 4.8 | 84.4 | 18.3 | 95.5 | 5.4 | 108.8 | 5.4 |
| AD-70046 | 81.3 | 20.3 | 61.2 | 21.6 | 95.5 | 5.4 | 111.8 | 18.5 |
| AD-70047 | 59.7 | 12.4 | 82.7 | 28.2 | 100.0 | 9.7 | 93.2 | 14.2 |
| AD-70048 | 46.7 | 8.6 | 61.3 | 10.3 | 96.8 | 11.9 | 109.7 | 23.7 |
| AD-70049 | 33.8 | 10.8 | 76.7 | 15.3 | 20.4 | 5.7 | 95.4 | 6.8 |
| AD-70050 | 27.1 | 4.7 | 57.7 | 4.9 | 107.8 | 11.0 | 101.1 | 5.2 |
| AD-70051 | 27.6 | 7.3 | 76.8 | 6.7 | 101.5 | 14.5 | 99.1 | 12.7 |
| AD-70052 | 36.2 | 13.1 | 37.6 | 14.8 | 110.3 | 11.4 | 109.3 | 14.8 |
| AD-70053 | 26.7 | 5.9 | 86.9 | 15.1 | 104.6 | 21.4 | 100.9 | 9.7 |
| AD-70055 | 36.5 | 7.6 | 58.9 | 16.7 | 105.0 | 14.5 | 98.7 | 8.0 |
| AD-69970 | 47.5 | 4.5 | 48.5 | 7.1 | 6.1 | 0.9 | 22.5 | 7.7 |
| AD-69971 | 60.2 | 11.6 | 88.4 | 25.0 | 10.1 | 4.8 | 33.2 | 10.4 |
| AD-69972 | 52.8 | 4.5 | 67.8 | 17.0 | 6.5 | 1.9 | 25.5 | 10.9 |
| AD-69973 | 36.2 | 5.3 | 64.5 | 13.0 | 46.6 | 13.2 | 50.1 | 13.9 |
| AD-69974 | 30.3 | 3.5 | 60.8 | 11.2 | 9.1 | 1.5 | 44.8 | 11.0 |
| AD-69975 | 29.7 | 3.2 | 48.6 | 8.2 | 12.5 | 6.2 | 20.3 | 3.2 |
| AD-69976 | 40.4 | 6.0 | 67.6 | 5.4 | 10.4 | 2.3 | 45.9 | 10.3 |
| AD-69977 | 45.7 | 7.1 | 91.6 | 12.5 | 6.3 | 0.9 | 19.7 | 3.4 |
| AD-69979 | 25.8 | 4.3 | 58.0 | 7.1 | 14.6 | 9.8 | 37.8 | 2.9 |
| AD-69980 | 30.9 | 7.9 | 51.6 | 13.5 | 9.5 | 2.6 | 23.1 | 6.3 |
| AD-69981 | 37.0 | 6.0 | 44.2 | 9.2 | 14.2 | 10.8 | 47.8 | 3.0 |
| AD-69982 | 22.6 | 2.8 | 48.4 | 10.7 | 9.3 | 1.2 | 30.4 | 10.0 |
| AD-69983 | 31.1 | 3.6 | 49.7 | 10.7 | 7.9 | 0.8 | 27.8 | 5.6 |
| AD-69984 | 39.7 | 6.8 | 66.2 | 13.0 | 49.0 | 1.1 | 87.8 | 13.2 |
| AD-69985 | 39.2 | 4.5 | 47.7 | 5.4 | 14.0 | 3.9 | 40.0 | 8.3 |
| AD-69986 | 21.0 | 8.3 | 55.4 | 7.9 | 6.8 | 0.7 | 24.0 | 0.7 |
| AD-69987 | 18.6 | 6.0 | 49.4 | 10.0 | 11.5 | 6.0 | 14.3 | 3.6 |
| AD-69988 | 29.5 | 3.1 | 56.4 | 9.9 | 10.7 | 3.7 | 17.2 | 5.5 |
| AD-69989 | 28.4 | 7.8 | 61.5 | 8.3 | 13.3 | 7.5 | 22.9 | 5.7 |
| AD-69990 | 28.4 | 4.0 | 66.5 | 18.3 | 13.5 | 7.9 | 46.4 | 8.6 |
| AD-69991 | 37.4 | 8.1 | 48.6 | 3.8 | 12.4 | 1.3 | 52.4 | 4.5 |
| AD-69992 | 31.3 | 5.6 | 63.3 | 23.3 | 117.7 | 27.8 | 101.8 | 4.3 |
| AD-69993 | 40.4 | 3.1 | 54.4 | 5.3 | 86.3 | 12.9 | 86.7 | 9.5 |
| AD-69994 | 30.1 | 7.5 | 60.5 | 5.5 | 46.0 | 15.2 | 78.7 | 11.6 |
| AD-69995 | 51.9 | 7.6 | 98.7 | 22.7 | 17.0 | 2.3 | 72.0 | 3.2 |
| AD-69996 | 34.3 | 4.5 | 43.2 | 4.9 | 72.1 | 14.5 | 89.4 | 9.5 |
| AD-69998 | 37.3 | 4.3 | 64.0 | 2.8 | 120.6 | 15.1 | 105.5 | 15.8 |

TABLE 5-continued

Single dose screen in Primary Cynomolgus Hepatocytes and Primary Mouse Hepatocytes

| Duplex ID | Primary Cynomolgus Hepatocytes | | | | Primary Mouse Hepatocytes | | | |
|---|---|---|---|---|---|---|---|---|
| | 10 nM Avg | 10 nM SD | 0.1 nM Avg | 0.1 nM SD | 10 nM Avg | 10 nM SD | 0.1 nM Avg | 0.1 nM SD |
| AD-69999 | 60.4 | 13.0 | 97.6 | 20.1 | 122.9 | 40.3 | 92.6 | 12.9 |
| AD-70000 | 74.5 | 11.1 | 84.3 | 9.5 | 120.4 | 15.4 | 97.9 | 27.4 |
| AD-70001 | 39.8 | 5.9 | 73.5 | 11.2 | 121.6 | 16.8 | 101.7 | 19.2 |
| AD-70002 | 35.7 | 3.3 | 63.0 | 6.9 | 102.2 | 8.7 | 84.2 | 15.9 |
| AD-70003 | 26.4 | 4.3 | 55.7 | 5.1 | 9.8 | 3.3 | 43.1 | 11.1 |
| AD-70004 | 42.1 | 5.9 | 58.1 | 15.0 | 130.1 | 45.5 | 104.0 | 9.4 |
| AD-70005 | 25.7 | 2.5 | 53.8 | 5.4 | 146.4 | 47.4 | 102.7 | 18.9 |
| AD-70006 | 31.6 | 3.7 | 50.4 | 1.5 | 110.2 | 19.2 | 106.4 | 15.4 |
| AD-70007 | 31.1 | 4.4 | 49.5 | 4.9 | 120.1 | 16.3 | 89.2 | 3.0 |
| AD-70008 | 40.2 | 3.6 | 64.4 | 3.2 | 106.1 | 13.1 | 105.6 | 22.0 |
| AD-70009 | 39.7 | 5.4 | 63.7 | 3.5 | 112.1 | 8.1 | 98.7 | 20.3 |
| AD-70010 | 96.3 | 26.2 | 110.6 | 11.7 | 5.2 | 1.4 | 10.2 | 3.4 |
| AD-70011 | 77.0 | 10.7 | 102.9 | 12.6 | 10.3 | 1.1 | 15.9 | 2.0 |
| AD-70012 | 92.4 | 23.9 | 95.6 | 7.4 | 8.1 | 1.4 | 16.1 | 2.7 |
| AD-70013 | 44.8 | 9.2 | 79.9 | 2.3 | 6.7 | 0.8 | 14.3 | 3.0 |
| AD-70014 | 84.6 | 17.7 | 88.4 | 9.5 | 6.9 | 1.6 | 16.2 | 2.8 |
| AD-70015 | 48.4 | 14.9 | 80.8 | 6.2 | 8.0 | 2.2 | 14.5 | 2.4 |

Example 3. iRNA Synthesis and in Vitro Screening Primary Human Hepatocytes siRNA Design A set of siRNAs targeting human XDH "xanthine dehydrogenase" gene (human NCBI refseqID: NM_000379; NCBI GeneID: 7498) were designed using custom R and Python scripts. The human XDH REFSEQ mRNA has a length of 5717 bases. The rationale and method for the set of siRNA designs is as follows: the predicted efficacy for every potential 19mer siRNA from position 10 through position 5717 was determined with a linear model derived the direct measure of mRNA knockdown from more than 20,000 distinct siRNA designs targeting a large number of vertebrate genes. The custom Python script built the set of siRNAs by systematically selecting a siRNA every 11 bases along the target mRNA starting at position 10. At each of the positions, the neighboring siRNA (one position to the 5' end of the mRNA, one position to the 3' end of the mRNA) was swapped into the design set if the predicted efficacy was better than the efficacy at the exact every-11th siRNA. Low complexity siRNAs, i.e., those with Shannon Entropy measures below 1.35 were excluded from the set.

A detailed list of the unmodified XDH sense and antisense strand sequences is shown in Table 6 and a detailed list of the modified XDH sense and antisense strand sequences is shown in Table 7.

Cell Culture and Transfections

Primary human hepatocytes were thawed and cultured in WMEM with 5% FBS and maintenance reagents (Invitrogen, Carlsbad Calif. Cat #CM3000) on collagen-coated plates. After 24 hours, media was removed and replaced with 40 µl of WMEM with maintenance reagents (Inivtrogen, Carlsbad Calif. Cat #CM4000) containing ~5×10³ cells. Separately, 7.35 µl of Opti-MEM plus 0.15 µl of Lipofectamine RNAiMax per well (Invitrogen, Carlsbad Calif. cat #13778-150) was added to 7.5 µl of siRNA duplexe and incubated at room temperature for 20 minutes. Ten µl of lipoplex mixture was then transferred to the cells. Cells were incubated for 24 hours prior to RNA purification. Single dose experiments were performed at 10 nM final duplex concentration.

Total RNA Isolation Using DYNABEADS mRNA Isolation Kit:

RNA was isolated using an automated protocol on a BioTek-EL406 platform using DYNABEADs (Invitrogen, cat #61012). Briefly, 50 µl of Lysis/Binding Buffer and 25 µl of lysis buffer containing 3 µl of magnetic beads were added to the plate with cells. Plates were incubated on an electromagnetic shaker for 10 minutes at room temperature and then magnetic beads were captured and the supernatant was removed. Bead-bound RNA was then washed 2 times with 150 µl Wash Buffer A and once with Wash Buffer B. Beads were then washed with 150 µl Elution Buffer, re-captured and supernatant removed.

cDNA Synthesis Using ABI High Capacity cDNA Reverse Transcription Kit (Applied Biosystems, Foster City, Calif., Cat #4368813):

Ten µl of a master mix containing 1 µl 10× Buffer, 0.4 µl 25× dNTPs, 1 µl 10× Random primers, 0.5 µl Reverse Transcriptase, 0.5 µl RNase inhibitor and 6.6 µl of H₂O per reaction was added to RNA isolated above. Plates were sealed, mixed, and incubated on an electromagnetic shaker for 10 minutes at room temperature, followed by 2 hours at 37° C.

Real Time PCR:

Two µl of cDNA were added to a master mix containing 0.5 µl of GAPDH TaqMan Probe (4326317E), 0.5 µl XDH probe (Hs00166010_m1) and 50 Lightcycler 480 probe master mix (Roche Cat #04887301001) per well in a 384 well plates (Roche cat #04887301001). Real time PCR was done in a LightCycler480 Real Time PCR system (Roche) using the ΔΔCt(RQ) assay. Each duplex was tested in four independent transfections.

To calculate relative fold change, real time data was analyzed using the ΔΔCt method and normalized to assays performed with mock transfected cells.

Table 8 shows the results of a single dose screen in Primary Human Hepatocytes transfected with the indicated iRNAs.

TABLE 6

XDH Unmodified Sequences

| Duplex Name | Sense Oligo Name | Sense Sequence (5' to 3') | SEQ ID NO | Position in NM_000379.3 | Antisense Oligo Name | Antisense Sequence (5'-3') | SEQ ID NO | Position in NM_000379.3 |
|---|---|---|---|---|---|---|---|---|
| AD-71930 | A-143855 | ACUACCUGCCAGUGUCUCU | 363 | 18-36 | A-143856 | AGAGACACUGGCAGGUAGU | 677 | 18-36 |
| AD-71931 | A-143857 | UUAGGAGUGAGGUACCUGA | 364 | 36-54 | A-143858 | UCAGGUACCUCACUCCUAA | 678 | 36-54 |
| AD-71932 | A-143861 | AACCUGUGACAAUGACAGA | 365 | 69-87 | A-143862 | UCUGUCAUUGUCACAGGUU | 679 | 69-87 |
| AD-71933 | A-143863 | GCAGACAAAUUGGUUUUCU | 366 | 86-104 | A-143864 | AGAAAACCAAUUUGUCUGC | 680 | 86-104 |
| AD-71934 | A-143865 | UUUGUGAAUGGCAGAAAGA | 367 | 104-122 | A-143866 | UCUUUCUGCCAUUCACAAA | 681 | 104-122 |
| AD-71935 | A-143867 | AAGGUGGUGGAGAAAAAUA | 368 | 119-137 | A-143868 | UAUUUUUCUCCACCACCUU | 682 | 119-137 |
| AD-71936 | A-143871 | CCUUUUGGCCUACCUGAGA | 369 | 154-172 | A-143872 | UCUCAGGUAGGCCAAAAGG | 683 | 154-172 |
| AD-71937 | A-143873 | AAGAAAGUUGGGCUGAGU | 370 | 172-190 | A-143874 | ACUCAGCCCCAACUUUCUU | 684 | 172-190 |
| AD-71938 | A-143875 | AGUGGAACCAAGCUCGCU | 371 | 188-206 | A-143876 | AGCCGAGCUUGGUUCCACU | 685 | 188-206 |
| AD-71939 | A-143877 | CUGUGGAGAGGGGGCUGA | 372 | 205-223 | A-143878 | UCAGCCCCCUCUCCACAG | 686 | 205-223 |
| AD-71940 | A-143879 | CGGGGCUUGCACAGUGAUA | 373 | 223-241 | A-143880 | UAUCACUGUGCAAGCCCCG | 687 | 223-241 |
| AD-71941 | A-143881 | AUGCUCUCCAAGUAUGAUA | 374 | 239-257 | A-143882 | UAUCAUACUUGGAGAGCAU | 688 | 239-257 |
| AD-71942 | A-143885 | UCGUCCACUUUUCUGCCAA | 375 | 273-291 | A-143886 | UUGGCAGAAAAGUGGACGA | 689 | 273-291 |
| AD-71943 | A-143887 | AUGCCUGCCUGGCCCCAU | 376 | 291-309 | A-143888 | AUGGGGCCAGGCAGGCAU | 690 | 291-309 |
| AD-71944 | A-143889 | AUCUGCUCCUUGCACCAUA | 377 | 308-326 | A-143890 | UAUGGUGCAAGGAGCAGAU | 691 | 308-326 |
| AD-71945 | A-143891 | UGUUGCAGUGACAACUGUA | 378 | 325-343 | A-143892 | UACAGUUGUCACUGCAACA | 692 | 325-343 |
| AD-71946 | A-143893 | UGGAAGGAAUAGGAAGCAA | 379 | 342-360 | A-143894 | UUGCUUCCUAUUCCUUCCA | 693 | 342-360 |
| AD-71947 | A-143895 | CACCAAGACGAGGCUGCAU | 380 | 358-376 | A-143896 | AUGCAGCCUCGUCUUGGUG | 694 | 358-376 |
| AD-71948 | A-143897 | UCCUGUGCAGGAGAGAAUU | 381 | 376-394 | A-143898 | AAUUCUCUCCUGCACAGGA | 695 | 376-394 |
| AD-71949 | A-143899 | AUUGCCAAAAGCCACGGCU | 382 | 392-410 | A-143900 | AGCCGUGGCUUUUGGCAAU | 696 | 392-410 |
| AD-71950 | A-143901 | UCCCAGUGCGGGUUCUGCA | 383 | 410-428 | A-143902 | UGCAGAACCCGCACUGGGA | 697 | 410-428 |
| AD-71951 | A-143903 | UGCACCCCUGGCAUCGUCA | 384 | 425-443 | A-143904 | UGACGAUGCCAGGGGUGCA | 698 | 425-443 |
| AD-71952 | A-143905 | UGAGUAUGUACACACUGCU | 385 | 444-462 | A-143906 | AGCAGUGUGUACAUACUCA | 699 | 444-462 |
| AD-71953 | A-143907 | UGCUCCGGAAUCAGCCCGA | 386 | 459-477 | A-143908 | UCGGGCUGAUUCCGGAGCA | 700 | 459-477 |
| AD-71954 | A-143909 | AGCCCACCAUGGAGGAGAU | 387 | 477-495 | A-143910 | AUCUCCUCCAUGGUGGGCU | 701 | 477-495 |
| AD-71955 | A-143911 | UUGAGAAUGCCUUCCAAGA | 388 | 495-513 | A-143912 | UCUUGGAAGGCAUUCUCAA | 702 | 495-513 |
| AD-71956 | A-143913 | AAGGAAAUCUGUGCCGCUA | 389 | 510-528 | A-143914 | UAGCGGCACAGAUUUCCUU | 703 | 510-528 |
| AD-71957 | A-143915 | CACAGGCUACAGACCCAUA | 390 | 529-547 | A-143916 | UAUGGGUCUGUAGCCUGUG | 704 | 529-547 |
| AD-71958 | A-143917 | CAUCCUCCAGGGCUUCCGA | 391 | 544-562 | A-143918 | UCGGAAGCCCUGGAGGAUG | 705 | 544-562 |
| AD-71959 | A-143919 | ACCUUUGCCAGGGAUGGUA | 392 | 563-581 | A-143920 | UACCAUCCCUGGCAAAGGU | 706 | 563-581 |
| AD-71960 | A-143921 | UGGAUGCUGUGGAGGAGAU | 393 | 580-598 | A-143922 | AUCUCCUCCACAGCAUCCA | 707 | 580-598 |
| AD-71961 | A-143923 | GAUGGGAAUAAUCCAAAUU | 394 | 596-614 | A-143924 | AAUUUGGAUUAUUCCCAUC | 708 | 596-614 |
| AD-71962 | A-143927 | AGAAAGACCACUCAGUCAA | 395 | 630-648 | A-143928 | UUGACUGAGUGGUCUUUCU | 709 | 630-648 |
| AD-71963 | A-143929 | AGCCUCUCGCCAUCUUUAU | 396 | 647-665 | A-143930 | AUAAAGAUGGCGAGAGGCU | 710 | 647-665 |
| AD-71964 | A-143931 | UAUUCAAACCAGAGGAGUU | 397 | 663-681 | A-143932 | AACUCCUCUGGUUUGAAUA | 711 | 663-681 |
| AD-71965 | A-143933 | UUCACGCCCCUGGAUCCAA | 398 | 680-698 | A-143934 | UUGGAUCCAGGGGCGUGAA | 712 | 680-698 |
| AD-71966 | A-143935 | AACCCAGGAGCCCAUUUUU | 399 | 697-715 | A-143936 | AAAAAUGGGCUCCUGGGUU | 713 | 697-715 |

TABLE 6-continued

XDH Unmodified Sequences

| Duplex Name | Sense Oligo Name | Sense Sequence (5' to 3') | SEQ ID NO | Position in NM_000379.3 | Antisense Oligo Name | Antisense Sequence (5'-3') | SEQ ID NO | Position in NM_000379.3 |
|---|---|---|---|---|---|---|---|---|
| AD-71967 | A-143937 | UUCCCCAGAGUUGCUGAA | 400 | 714-732 | A-143938 | UUCAGCAACUCUGGGGGAA | 714 | 714-732 |
| AD-71968 | A-143939 | AGGCUGAAAGACACUCCUA | 401 | 731-749 | A-143940 | UAGGAGUGUCUUUCAGCCU | 715 | 731-749 |
| AD-71969 | A-143941 | UCGGAAGCAGCUGCGAUUU | 402 | 748-766 | A-143942 | AAAUCGCAGCUGCUUCCGA | 716 | 748-766 |
| AD-71970 | A-143943 | UUGAAGGGGAGCGUGUGAA | 403 | 765-783 | A-143944 | UUCACACGCUCCCCUUCAA | 717 | 765-783 |
| AD-71971 | A-143945 | CGUGGAUACAGGCCUCAAA | 404 | 783-801 | A-143946 | UUUGAGGCCUGUAUCCACG | 718 | 783-801 |
| AD-71972 | A-143947 | AACCCUCAAGGAGCUGCUA | 405 | 799-817 | A-143948 | UAGCAGCUCCUUGAGGGUU | 719 | 799-817 |
| AD-71973 | A-143949 | UGGACCUCAAGGCUCAGCA | 406 | 816-834 | A-143950 | UGCUGAGCCUUGAGGUCCA | 720 | 816-834 |
| AD-71974 | A-143951 | ACCCUGACGCCAAGCUGGU | 407 | 834-852 | A-143952 | ACCAGCUUGGCGUCAGGGU | 721 | 834-852 |
| AD-71975 | A-143953 | UCGUGGGGAACACGGAGAU | 408 | 852-870 | A-143954 | AUCUCCGUGUUCCCCACGA | 722 | 852-870 |
| AD-71976 | A-143955 | AUUGGCAUUGAGAUGAAGU | 409 | 869-887 | A-143956 | ACUUCAUCUCAAUGCCAAU | 723 | 869-887 |
| AD-71977 | A-143957 | AAGUUCAAGAAUAUGCUGU | 410 | 884-902 | A-143958 | ACAGCAUAUUCUUGAACUU | 724 | 884-902 |
| AD-71978 | A-143959 | UUUCCUAUGAUUGUCUGCA | 411 | 902-920 | A-143960 | UGCAGACAAUCAUAGGAAA | 725 | 902-920 |
| AD-71979 | A-143961 | CCCAGCCUGGAUCCCUGAA | 412 | 919-937 | A-143962 | UUCAGGGAUCCAGGCUGGG | 726 | 919-937 |
| AD-71980 | A-143963 | AGCUGAAUUCGGUAGAACA | 413 | 936-954 | A-143964 | UGUUCUACCGAAUUCAGCU | 727 | 936-954 |
| AD-71981 | A-143965 | CAUGGACCCGACGGUAUCU | 414 | 953-971 | A-143966 | AGAUACCGUCGGGUCCAUG | 728 | 953-971 |
| AD-71982 | A-143967 | UCUCCUUUGGAGCUGCUUA | 415 | 969-987 | A-143968 | UAAGCAGCUCCAAAGGAGA | 729 | 969-987 |
| AD-71983 | A-143969 | UGCCCCUGAGCAUUGUGA | 416 | 986-1004 | A-143970 | UCACAAUGCUCAGGGGGCA | 730 | 986-1004 |
| AD-71984 | A-143971 | AAAAAACCCUGGUGGAUGA | 417 | 1005-1023 | A-143972 | UCAUCCACCAGGGUUUUUU | 731 | 1005-1023 |
| AD-71985 | A-143973 | UGCUGUUGCUAAGCUUCCU | 418 | 1021-1039 | A-143974 | AGGAAGCUUAGCAACAGCA | 732 | 1021-1039 |
| AD-71986 | A-143975 | CCUGCCCAAAAGACAGAGA | 419 | 1037-1055 | A-143976 | UCUCUGUCUUUUGGGCAGG | 733 | 1037-1055 |
| AD-71987 | A-143977 | UGUUCAGAGGGGUCCGGA | 420 | 1056-1074 | A-143978 | UCCAGGACCCCUCUGAACA | 734 | 1056-1074 |
| AD-71988 | A-143979 | UGGAGCAGCUGCGCUGGUU | 421 | 1071-1089 | A-143980 | AACCAGCGCAGCUGCUCCA | 735 | 1071-1089 |
| AD-71989 | A-143981 | UUUGCUGGGAAGCAAGUCA | 422 | 1088-1106 | A-143982 | UGACUUGCUUCCCAGCAAA | 736 | 1088-1106 |
| AD-71990 | A-143983 | CAAGUCUGUGGCGUCCGUU | 423 | 1105-1123 | A-143984 | AACGGACGCCACAGACUUG | 737 | 1105-1123 |
| AD-71991 | A-143985 | UGGAGGGAACAUCAUCACU | 424 | 1123-1141 | A-143986 | AGUGAUGAUGUUCCCUCCA | 738 | 1123-1141 |
| AD-71992 | A-143987 | UGCCAGCCCCAUCUCCGAA | 425 | 1141-1159 | A-143988 | UUCGGAGAUGGGGCUGGCA | 739 | 1141-1159 |
| AD-71993 | A-143989 | ACCUCAACCCCGUGUUCAU | 426 | 1158-1176 | A-143990 | AUGAACACGGGGUUGAGGU | 740 | 1158-1176 |
| AD-71994 | A-143991 | UCAUGGCCAGUGGGGCCAA | 427 | 1173-1191 | A-143992 | UUGGCCCCACUGGCCAUGA | 741 | 1173-1191 |
| AD-71995 | A-143993 | AAGCUGACACUUGUGUCCA | 428 | 1190-1208 | A-143994 | UGGACACAAGUGUCAGCUU | 742 | 1190-1208 |
| AD-71996 | A-143995 | CAGAGGCACCAGGAGAACU | 429 | 1207-1225 | A-143996 | AGUUCUCCUGGUGCCUCUG | 743 | 1207-1225 |
| AD-71997 | A-143997 | UGUCCAGAUGGACCACACA | 430 | 1225-1243 | A-143998 | UGUGUGGUCCAUCUGGACA | 744 | 1225-1243 |
| AD-71998 | A-143999 | CCUUCUUCCCUGGCUACAA | 431 | 1242-1260 | A-144000 | UUGUAGCCAGGGAAGAAGG | 745 | 1242-1260 |
| AD-71999 | A-144001 | AGAAAGACCCUGCUGAGCA | 432 | 1259-1277 | A-144002 | UGCUCAGCAGGGUCUUUCU | 746 | 1259-1277 |
| AD-72000 | A-144003 | CCGGAGGAGAUACUGCUCU | 433 | 1277-1295 | A-144004 | AGAGCAGUAUCUCCUCCGG | 747 | 1277-1295 |
| AD-72001 | A-144005 | CUCUCCAUAGAGAUCCCCU | 434 | 1292-1310 | A-144006 | AGGGGAUCUCUAUGGAGAG | 748 | 1292-1310 |
| AD-72002 | A-144007 | UACAGCAGGGAGGGGAGU | 435 | 1310-1328 | A-144008 | ACUCCCCCUCCCUGCUGUA | 749 | 1310-1328 |
| AD-72003 | A-144009 | AGUAUUUCUCAGCAUUCAA | 436 | 1326-1344 | A-144010 | UUGAAUGCUGAGAAAUACU | 750 | 1326-1344 |

TABLE 6-continued

XDH Unmodified Sequences

| Duplex Name | Sense Oligo Name | Sense Sequence (5' to 3') | SEQ ID NO | Position in NM_000379.3 | Antisense Oligo Name | Antisense Sequence (5'-3') | SEQ ID NO | Position in NM_000379.3 |
|---|---|---|---|---|---|---|---|---|
| AD-72004 | A-144011 | AAGCAGGCCUCCCGGAGAA | 437 | 1343-1361 | A-144012 | UUCUCCGGGAGGCCUGCUU | 751 | 1343-1361 |
| AD-72005 | A-144013 | AAGAUGACAUUGCCAAGGU | 438 | 1362-1380 | A-144014 | ACCUUGGCAAUGUCAUCUU | 752 | 1362-1380 |
| AD-72006 | A-144015 | GGUAACCAGUGGCAUGAGA | 439 | 1378-1396 | A-144016 | UCUCAUGCCACUGGUUACC | 753 | 1378-1396 |
| AD-72007 | A-144017 | AGAGUUUUAUUCAAGCCAA | 440 | 1394-1412 | A-144018 | UUGGCUUGAAUAAAACUCU | 754 | 1394-1412 |
| AD-72008 | A-144019 | AGGAACCACAGAGGUACAA | 441 | 1411-1429 | A-144020 | UUGUACCUCUGUGGUUCCU | 755 | 1411-1429 |
| AD-72009 | A-144021 | AGGAGCUGGCCCUUUGCUA | 442 | 1428-1446 | A-144022 | UAGCAAAGGGCCAGCUCCU | 756 | 1428-1446 |
| AD-72010 | A-144023 | UAUGGUGGAAUGGCCAACA | 443 | 1445-1463 | A-144024 | UGUUGGCCAUUCCACCAUA | 757 | 1445-1463 |
| AD-72011 | A-144025 | AGAACCAUCUCAGCCCUCA | 444 | 1463-1481 | A-144026 | UGAGGGCUGAGAUGGUUCU | 758 | 1463-1481 |
| AD-72012 | A-144027 | AAGACCACUCAGAGGCAGA | 445 | 1481-1499 | A-144028 | UCUGCCUCUGAGUGGUCUU | 759 | 1481-1499 |
| AD-72013 | A-144029 | CAGCUUUCCAAGCUCUGGA | 446 | 1496-1514 | A-144030 | UCCAGAGCUUGGAAAGCUG | 760 | 1496-1514 |
| AD-72014 | A-144031 | AGGAGGAGCUGCUGCAGGA | 447 | 1515-1533 | A-144032 | UCCUGCAGCAGCUCCUCCU | 761 | 1515-1533 |
| AD-72015 | A-144033 | AGGACGUGUGUGCAGGACU | 448 | 1530-1548 | A-144034 | AGUCCUGCACACACGUCCU | 762 | 1530-1548 |
| AD-72016 | A-144035 | UGGCAGAGGAGCUGCAUCU | 449 | 1548-1566 | A-144036 | AGAUGCAGCUCCUCUGCCA | 763 | 1548-1566 |
| AD-72017 | A-144037 | UCUGCCUCCCGAUGCCCCU | 450 | 1564-1582 | A-144038 | AGGGGCAUCGGGAGGCAGA | 764 | 1564-1582 |
| AD-72018 | A-144039 | GGUGGCAUGGUGGACUUCA | 451 | 1583-1601 | A-144040 | UGAAGUCCACCAUGCCACC | 765 | 1583-1601 |
| AD-72019 | A-144041 | UUCCGGUGCACCCUCACCA | 452 | 1598-1616 | A-144042 | UGGUGAGGGUGCACCGGAA | 766 | 1598-1616 |
| AD-71752 | A-144043 | UCAGCUUCUUCUUCAAGUU | 453 | 1617-1635 | A-144044 | AACUUGAAGAAGAAGCUGA | 767 | 1617-1635 |
| AD-71753 | A-144045 | UUCUACCUGACAGUCCUUA | 454 | 1634-1652 | A-144046 | UAAGGACUGUCAGGUAGAA | 768 | 1634-1652 |
| AD-71754 | A-144049 | GAGAACCUGGAAGACAAGU | 455 | 1667-1685 | A-144050 | ACUUGUCUUCCAGGUUCUC | 769 | 1667-1685 |
| AD-71755 | A-144051 | UGUGGUAAACUGGACCCCA | 456 | 1685-1703 | A-144052 | UGGGGUCCAGUUUACCACA | 770 | 1685-1703 |
| AD-71756 | A-144053 | CACUUUCGCCAGUGCAACU | 457 | 1702-1720 | A-144054 | AGUUGCACUGGCGAAAGUG | 771 | 1702-1720 |
| AD-71757 | A-144055 | ACUUUACUGUUUCAGAAAG | 458 | 1718-1736 | A-144056 | CUUUCUGAAACAGUAAAGU | 772 | 1718-1736 |
| AD-71758 | A-144057 | AAGACCCCCAGCCGAUGU | 459 | 1734-1752 | A-144058 | ACAUCGGCUGGGGGUCUU | 773 | 1734-1752 |
| AD-71759 | A-144059 | UCCAGCUCUUCCAAGAGGU | 460 | 1752-1770 | A-144060 | ACCUCUUGGAAGAGCUGGA | 774 | 1752-1770 |
| AD-71760 | A-144061 | UGCCCAAGGGUCAGUCUGA | 461 | 1770-1788 | A-144062 | UCAGACUGACCCUUGGGCA | 775 | 1770-1788 |
| AD-71761 | A-144063 | GAGGAGGACAUGGUGGGCA | 462 | 1787-1805 | A-144064 | UGCCCACCAUGUCCUCCUC | 776 | 1787-1805 |
| AD-71762 | A-144065 | GCCGGCCCCUGCCCCACCU | 463 | 1803-1821 | A-144066 | AGGUGGGGCAGGGGCCGGC | 777 | 1803-1821 |
| AD-71763 | A-144067 | CCUGGCAGCGGACAUGCAA | 464 | 1819-1837 | A-144068 | UUGCAUGUCCGCUGCCAGG | 778 | 1819-1837 |
| AD-71764 | A-144069 | AGGCCUCUGGUGAGGCCGU | 465 | 1836-1854 | A-144070 | ACGGCCUCACCAGAGGCCU | 779 | 1836-1854 |
| AD-71765 | A-144071 | UGUACUGUGACGACAUUCA | 466 | 1854-1872 | A-144072 | UGAAUGUCGUCACAGUACA | 780 | 1854-1872 |
| AD-71766 | A-144073 | CUCGCUACGAGAAUGAGCU | 467 | 1872-1890 | A-144074 | AGCUCAUUCUCGUAGCGAG | 781 | 1872-1890 |
| AD-71767 | A-144075 | CUGUCUCCGGCUGGUCA | 468 | 1889-1907 | A-144076 | UGACCAGCCGGAGAGACAG | 782 | 1889-1907 |
| AD-71768 | A-144079 | CCACGCCAAGAUCAAGUCA | 469 | 1921-1939 | A-144080 | UGACUUGAUCUUGGCGUGG | 783 | 1921-1939 |
| AD-71769 | A-144081 | CAUAGAUACAUCAGAAGCU | 470 | 1939-1957 | A-144082 | AGCUUCUGAUGUAUCUAUG | 784 | 1939-1957 |
| AD-71770 | A-144085 | UUUGUUUGUUUCAUUUCCA | 471 | 1973-1991 | A-144086 | UGGAAAUGAAACAAACAAA | 785 | 1973-1991 |
| AD-71771 | A-144087 | GCUGAUGAUGUUCCUGGGA | 472 | 1991-2009 | A-144088 | UCCCAGGAACAUCAUCAGC | 786 | 1991-2009 |
| AD-71772 | A-144093 | CAGUCUUUGCGAAGGAUAA | 473 | 2040-2058 | A-144094 | UUAUCCUUCGCAAAGACUG | 787 | 2040-2058 |

TABLE 6-continued

XDH Unmodified Sequences

| Duplex Name | Sense Oligo Name | Sense Sequence (5' to 3') | SEQ ID NO | Position in NM_000379.3 | Antisense Oligo Name | Antisense Sequence (5'-3') | SEQ ID NO | Position in NM_000379.3 |
|---|---|---|---|---|---|---|---|---|
| AD-71773 | A-144095 | AAGGUUACUUGUGUUGGGA | 474 | 2057-2075 | A-144096 | UCCCAACACAAGUAACCUU | 788 | 2057-2075 |
| AD-71774 | A-144097 | CAUAUCAUUGGUGCUGUGA | 475 | 2075-2093 | A-144098 | UCACAGCACCAAUGAUAUG | 789 | 2075-2093 |
| AD-71775 | A-144099 | UGGUUGCUGACACCCCGGA | 476 | 2091-2109 | A-144100 | UCCGGGGUGUCAGCAACCA | 790 | 2091-2109 |
| AD-71776 | A-144101 | ACACACACAGAGAGCUGCA | 477 | 2110-2128 | A-144102 | UGCAGCUCUCUGUGUGUGU | 791 | 2110-2128 |
| AD-71777 | A-144103 | GCCCAAGGGGUGAAAAUCA | 478 | 2126-2144 | A-144104 | UGAUUUUCACCCCUUGGGC | 792 | 2126-2144 |
| AD-71778 | A-144105 | UCACCUAUGAAGAACUACA | 479 | 2142-2160 | A-144106 | UGUAGUUCUUCAUAGGUGA | 793 | 2142-2160 |
| AD-71779 | A-144109 | GAGGAUGCUAUAAAGAACA | 480 | 2177-2195 | A-144110 | UGUUCUUUAUAGCAUCCUC | 794 | 2177-2195 |
| AD-71780 | A-144111 | CAACUCCUUUUAUGGACCU | 481 | 2194-2212 | A-144112 | AGGUCCAUAAAAGGAGUUG | 795 | 2194-2212 |
| AD-71781 | A-144113 | CCUGAGCUGAAGAUCGAGA | 482 | 2210-2228 | A-144114 | UCUCGAUCUUCAGCUCAGG | 796 | 2210-2228 |
| AD-71782 | A-144115 | AAAGGGGACCUAAAGAAGA | 483 | 2228-2246 | A-144116 | UCUUCUUUAGGUCCCCUUU | 797 | 2228-2246 |
| AD-71783 | A-144117 | AGGGGUUUUCCGAAGCAGA | 484 | 2244-2262 | A-144118 | UCUGCUUCGGAAAACCCCU | 798 | 2244-2262 |
| AD-71784 | A-144119 | UAAUGUUGUGUCAGGGGAA | 485 | 2263-2281 | A-144120 | UUCCCCUGACACAACAUUA | 799 | 2263-2281 |
| AD-71785 | A-144121 | AGAUAUACAUCGGUGGCCA | 486 | 2280-2298 | A-144122 | UGGCCACCGAUGUAUAUCU | 800 | 2280-2298 |
| AD-71786 | A-144123 | GCCAAGAGCACUUCUACCU | 487 | 2295-2313 | A-144124 | AGGUAGAAGUGCUCUUGGC | 801 | 2295-2313 |
| AD-71787 | A-144125 | GGAGACUCACUGCACCAUU | 488 | 2314-2332 | A-144126 | AAUGGUGCAGUGAGUCUCC | 802 | 2314-2332 |
| AD-71788 | A-144127 | UUGCUGUUCCAAAAGGCGA | 489 | 2331-2349 | A-144128 | UCGCCUUUUGGAACAGCAA | 803 | 2331-2349 |
| AD-71789 | A-144129 | CGAGGCAGGGGAGAUGGAA | 490 | 2347-2365 | A-144130 | UUCCAUCUCCCCUGCCUCG | 804 | 2347-2365 |
| AD-71790 | A-144131 | AGCUCUUUGUGUCUACACA | 491 | 2364-2382 | A-144132 | UGUGUAGACACAAAGAGCU | 805 | 2364-2382 |
| AD-71791 | A-144133 | CAGAACACCAUGAAGACCA | 492 | 2381-2399 | A-144134 | UGGUCUUCAUGGUGUUCUG | 806 | 2381-2399 |
| AD-71792 | A-144135 | CAGAGCUUUGUUGCAAAAA | 493 | 2399-2417 | A-144136 | UUUUUGCAACAAAGCUCUG | 807 | 2399-2417 |
| AD-71793 | A-144137 | AAAAUGUUGGGGGUUCCAA | 494 | 2414-2432 | A-144138 | UUGGAACCCCCAACAUUUU | 808 | 2414-2432 |
| AD-71794 | A-144139 | AGCAAACCGGAUUGUGGUU | 495 | 2431-2449 | A-144140 | AACCACAAUCCGGUUUGCU | 809 | 2431-2449 |
| AD-71795 | A-144141 | UUCGAGUGAAGAGAAUGGA | 496 | 2448-2466 | A-144142 | UCCAUUCUCUUCACUCGAA | 810 | 2448-2466 |
| AD-71796 | A-144143 | AGGAGGCUUUGGAGGCAAA | 497 | 2467-2485 | A-144144 | UUUGCCUCCAAAGCCUCCU | 811 | 2467-2485 |
| AD-71797 | A-144145 | AAGGAGACCCGGAGCACUA | 498 | 2483-2501 | A-144146 | UAGUGCUCCGGGUCUCCUU | 812 | 2483-2501 |
| AD-71798 | A-144147 | UGUGGUGUCCACGGCAGUA | 499 | 2500-2518 | A-144148 | UACUGCCGUGGACACCACA | 813 | 2500-2518 |
| AD-71799 | A-144149 | UGGCCCUGGCUGCAUAUAA | 500 | 2517-2535 | A-144150 | UUAUAUGCAGCCAGGGCCA | 814 | 2517-2535 |
| AD-71800 | A-144153 | UGCGAUGCAUGCUGGACCA | 501 | 2550-2568 | A-144154 | UGGUCCAGCAUGCAUCGCA | 815 | 2550-2568 |
| AD-71801 | A-144155 | CGUGAUGAGGACAUGCUGA | 502 | 2567-2585 | A-144156 | UCAGCAUGUCCUCAUCACG | 816 | 2567-2585 |
| AD-71802 | A-144157 | UAACUGGUGGCAGACAUCA | 503 | 2586-2604 | A-144158 | UGAUGUCUGCCACCAGUUA | 817 | 2586-2604 |
| AD-71803 | A-144159 | UCCCUUCCUGGCCAGAUAA | 504 | 2602-2620 | A-144160 | UUAUCUGGCCAGGAAGGGA | 818 | 2602-2620 |
| AD-71804 | A-144161 | UACAAGGUUGGCUUCAUGA | 505 | 2618-2636 | A-144162 | UCAUGAAGCCAACCUUGUA | 819 | 2618-2636 |
| AD-71805 | A-144163 | AGACUGGGACAGUUGUGGA | 506 | 2637-2655 | A-144164 | UCCACAACUGUCCCAGUCU | 820 | 2637-2655 |
| AD-71806 | A-144165 | GCUCUUGAGGUGGACCACU | 507 | 2654-2672 | A-144166 | AGUGGUCCACCUCAAGAGC | 821 | 2654-2672 |
| AD-71807 | A-144167 | ACUUCAGCAAUGUGGGAA | 508 | 2670-2688 | A-144168 | UUCCCCACAUUGCUGAAGU | 822 | 2670-2688 |
| AD-71808 | A-144169 | GAACACCCAGGAUCUCUCU | 509 | 2686-2704 | A-144170 | AGAGAGAUCCUGGGUGUUC | 823 | 2686-2704 |
| AD-71809 | A-144171 | CAGAGUAUUAUGGAACGAA | 510 | 2705-2723 | A-144172 | UUCGUUCCAUAAUACUCUG | 824 | 2705-2723 |

TABLE 6-continued

XDH Unmodified Sequences

| Duplex Name | Sense Oligo Name | Sense Sequence (5' to 3') | SEQ ID NO | Position in NM_000379.3 | Antisense Oligo Name | Antisense Sequence (5'-3') | SEQ ID NO | Position in NM_000379.3 |
|---|---|---|---|---|---|---|---|---|
| AD-71810 | A-144173 | AGCUUUAUUCCACAUGGAA | 511 | 2722-2740 | A-144174 | UUCCAUGUGGAAUAAAGCU | 825 | 2722-2740 |
| AD-71811 | A-144175 | ACAACUGCUAUAAAAUCCA | 512 | 2739-2757 | A-144176 | UGGAUUUUAUAGCAGUUGU | 826 | 2739-2757 |
| AD-71812 | A-144177 | UCCCCAACAUCCGGGGCAA | 513 | 2754-2772 | A-144178 | UUGCCCCGGAUGUUGGGGA | 827 | 2754-2772 |
| AD-71813 | A-144179 | UGGGCGGCUGUGCAAAACA | 514 | 2773-2791 | A-144180 | UGUUUUGCACAGCCGCCCA | 828 | 2773-2791 |
| AD-71814 | A-144181 | AACCAACCUUCCCUCCAAA | 515 | 2788-2806 | A-144182 | UUUGGAGGGAAGGUUGGUU | 829 | 2788-2806 |
| AD-71815 | A-144183 | ACACGGCCUUCCGGGGCUU | 516 | 2805-2823 | A-144184 | AAGCCCCGGAAGGCCGUGU | 830 | 2805-2823 |
| AD-71816 | A-144185 | UUGGGGGGCCCCAGGGGAU | 517 | 2823-2841 | A-144186 | AUCCCCUGGGGCCCCCCAA | 831 | 2823-2841 |
| AD-71817 | A-144187 | AUGCUCAUUGCCGAGUGCU | 518 | 2840-2858 | A-144188 | AGCACUCGGCAAUGAGCAU | 832 | 2840-2858 |
| AD-71818 | A-144189 | UGGAUGAGUGAAGUUGCAA | 519 | 2858-2876 | A-144190 | UUGCAACUUCACUCAUCCA | 833 | 2858-2876 |
| AD-71819 | A-144191 | AGUGACCUGUGGGAUGCCU | 520 | 2875-2893 | A-144192 | AGGCAUCCCACAGGUCACU | 834 | 2875-2893 |
| AD-71820 | A-144193 | CCUGCAGAGGAGGUGCGGA | 521 | 2891-2909 | A-144194 | UCCGCACCUCCUCUGCAGG | 835 | 2891-2909 |
| AD-71821 | A-144195 | AGAAAAAACCUGUACAAAG | 522 | 2909-2927 | A-144196 | CUUUGUACAGGUUUUUUCU | 836 | 2909-2927 |
| AD-71822 | A-144197 | AAAGAAGGGGACCUGACAA | 523 | 2924-2942 | A-144198 | UUGUCAGGUCCCCUUCUUU | 837 | 2924-2942 |
| AD-71823 | A-144199 | ACACUUCAACCAGAAGCUU | 524 | 2941-2959 | A-144200 | AAGCUUCUGGUUGAAGUGU | 838 | 2941-2959 |
| AD-71824 | A-144201 | UUGAGGGUUUCACCUUGCA | 525 | 2958-2976 | A-144202 | UGCAAGGUGAAACCCUCAA | 839 | 2958-2976 |
| AD-71825 | A-144203 | CAGAUGCUGGGAAGAAUGA | 526 | 2977-2995 | A-144204 | UCAUUCUUCCCAGCAUCUG | 840 | 2977-2995 |
| AD-71826 | A-144205 | UGCCUAGCAAGCUCUCAGU | 527 | 2993-3011 | A-144206 | ACUGAGAGCUUGCUAGGCA | 841 | 2993-3011 |
| AD-71827 | A-144207 | UAUCAUGCUCGGAAGAGUA | 528 | 3011-3029 | A-144208 | UACUCUUCCGAGCAUGAUA | 842 | 3011-3029 |
| AD-71828 | A-144209 | AGUGAGGUUGACAAGUUCA | 529 | 3026-3044 | A-144210 | UGAACUUGUCAACCUCACU | 843 | 3026-3044 |
| AD-71829 | A-144211 | AACAAGGAGAAUUGUUGGA | 530 | 3044-3062 | A-144212 | UCCAACAAUUCUCCUUGUU | 844 | 3044-3062 |
| AD-71830 | A-144213 | AAAAGAGAGGAUUGUGCA | 531 | 3062-3080 | A-144214 | UGCACAAUCCUCUCUUUUU | 845 | 3062-3080 |
| AD-71831 | A-144215 | CAUAAUUCCCACCAAGUUU | 532 | 3079-3097 | A-144216 | AAACUUGGUGGGAAUUAUG | 846 | 3079-3097 |
| AD-71832 | A-144217 | UUUGGAAUAAGCUUUACAA | 533 | 3095-3113 | A-144218 | UUGUAAAGCUUAUUCCAAA | 847 | 3095-3113 |
| AD-71833 | A-144219 | AGUUCCUUUUCUGAAUCAA | 534 | 3112-3130 | A-144220 | UUGAUUCAGAAAAGGAACU | 848 | 3112-3130 |
| AD-71834 | A-144221 | AGGCAGGAGCCCUACUUCA | 535 | 3129-3147 | A-144222 | UGAAGUAGGGCUCCUGCCU | 849 | 3129-3147 |
| AD-71835 | A-144223 | CAUGUGUACACAGAUGGCU | 536 | 3146-3164 | A-144224 | AGCCAUCUGUGUACACAUG | 850 | 3146-3164 |
| AD-71836 | A-144225 | UCUGUGCUGCUGACCCACA | 537 | 3164-3182 | A-144226 | UGUGGGUCAGCAGCACAGA | 851 | 3164-3182 |
| AD-71837 | A-144229 | GGCCAAGGCCUUCAUACCA | 538 | 3197-3215 | A-144230 | UGGUAUGAAGGCCUUGGCC | 852 | 3197-3215 |
| AD-71838 | A-144231 | AAAAUGGUCCAGGUGGCCA | 539 | 3215-3233 | A-144232 | UGGCCACCUGGACCAUUUU | 853 | 3215-3233 |
| AD-71839 | A-144233 | GCCAGUAGAGCUCUGAAAA | 540 | 3230-3248 | A-144234 | UUUUCAGAGCUCUACUGGC | 854 | 3230-3248 |
| AD-71840 | A-144235 | AAUCCCCACCUCUAAGAUU | 541 | 3247-3265 | A-144236 | AAUCUUAGAGGUGGGGAUU | 855 | 3247-3265 |
| AD-71841 | A-144237 | UAUAUCAGCGAGACAAGCA | 542 | 3266-3284 | A-144238 | UGCUUGUCUCGCUGAUAUA | 856 | 3266-3284 |
| AD-71842 | A-144239 | AGCACUAACACUGUGCCCA | 543 | 3281-3299 | A-144240 | UGGGCACAGUGUUAGUGCU | 857 | 3281-3299 |
| AD-71843 | A-144241 | CAACACCUCUCCCACGGCU | 544 | 3298-3316 | A-144242 | AGCCGUGGGAGAGGUGUUG | 858 | 3298-3316 |
| AD-71844 | A-144243 | UGCCUCUGUCAGCGCUGAA | 545 | 3316-3334 | A-144244 | UUCAGCGCUGACAGAGGCA | 859 | 3316-3334 |
| AD-71845 | A-144245 | ACCUCAAUGGACAGGCCGU | 546 | 3333-3351 | A-144246 | ACGGCCUGUCCAUUGAGGU | 860 | 3333-3351 |
| AD-71846 | A-144247 | GUCUAUGCGGCUUGUCAGA | 547 | 3350-3368 | A-144248 | UCUGACAAGCCGCAUAGAC | 861 | 3350-3368 |

TABLE 6-continued

XDH Unmodified Sequences

| Duplex Name | Sense Oligo Name | Sense Sequence (5' to 3') | SEQ ID NO | Position in NM_000379.3 | Antisense Oligo Name | Antisense Sequence (5'-3') | SEQ ID NO | Position in NM_000379.3 |
| --- | --- | --- | --- | --- | --- | --- | --- | --- |
| AD-71847 | A-144249 | AGACCAUCUUGAAAAGGCU | 548 | 3366-3384 | A-144250 | AGCCUUUUCAAGAUGGUCU | 862 | 3366-3384 |
| AD-71848 | A-144251 | UGGAACCCUACAAGAAGAA | 549 | 3384-3402 | A-144252 | UUCUUCUUGUAGGGUUCCA | 863 | 3384-3402 |
| AD-71849 | A-144253 | AAGAAUCCCAGUGGCUCCU | 550 | 3401-3419 | A-144254 | AGGAGCCACUGGGAUUCUU | 864 | 3401-3419 |
| AD-71850 | A-144255 | UGGGAAGACUGGGUCACAA | 551 | 3419-3437 | A-144256 | UUGUGACCCAGUCUUCCCA | 865 | 3419-3437 |
| AD-71851 | A-144257 | ACAGCUGCCUACAUGGACA | 552 | 3434-3452 | A-144258 | UGUCCAUGUAGGCAGCUGU | 866 | 3434-3452 |
| AD-71852 | A-144259 | ACAGUGAGCUUGUCUGCCA | 553 | 3452-3470 | A-144260 | UGGCAGACAAGCUCACUGU | 867 | 3452-3470 |
| AD-71853 | A-144261 | ACUGGGUUUUAUAGAACAA | 554 | 3470-3488 | A-144262 | UUGUUCUAUAAAACCCAGU | 868 | 3470-3488 |
| AD-71854 | A-144263 | ACCCAAUCUGGGCUACAGA | 555 | 3487-3505 | A-144264 | UCUGUAGCCCAGAUUGGGU | 869 | 3487-3505 |
| AD-71855 | A-144265 | CAGCUUUGAGACUAACUCA | 556 | 3502-3520 | A-144266 | UGAGUUAGUCUCAAAGCUG | 870 | 3502-3520 |
| AD-71856 | A-144267 | GGGAACCCCUUCCACUACU | 557 | 3521-3539 | A-144268 | AGUAGUGGAAGGGGUUCCC | 871 | 3521-3539 |
| AD-71857 | A-144269 | CUUCAGCUAUGGGGUGGCU | 558 | 3538-3556 | A-144270 | AGCCACCCCAUAGCUGAAG | 872 | 3538-3556 |
| AD-71858 | A-144271 | CUUGCUCUGAAGUAGAAAU | 559 | 3555-3573 | A-144272 | AUUUCUACUUCAGAGCAAG | 873 | 3555-3573 |
| AD-71859 | A-144273 | AAAUCGACUGCUAACAGA | 560 | 3570-3588 | A-144274 | UCUGUUAGGCAGUCGAUUU | 874 | 3570-3588 |
| AD-71860 | A-144275 | GAGAUCAUAAGAACCUCCA | 561 | 3588-3606 | A-144276 | UGGAGGUUCUUAUGAUCUC | 875 | 3588-3606 |
| AD-71861 | A-144277 | GCACAGAUAUUGUCAUGGA | 562 | 3606-3624 | A-144278 | UCCAUGACAAUAUCUGUGC | 876 | 3606-3624 |
| AD-71862 | A-144279 | UGGAUGUUGGCUCCAGUCU | 563 | 3621-3639 | A-144280 | AGACUGGAGCCAACAUCCA | 877 | 3621-3639 |
| AD-71863 | A-144281 | UAAACCCUGCCAUUGAUAU | 564 | 3639-3657 | A-144282 | AUAUCAAUGGCAGGGUUUA | 878 | 3639-3657 |
| AD-71864 | A-144283 | UUGGACAGGUGGAAGGGGA | 565 | 3657-3675 | A-144284 | UCCCCUUCCACCUGUCCAA | 879 | 3657-3675 |
| AD-71865 | A-144285 | GGGCAUUUGUCCAGGGCCU | 566 | 3672-3690 | A-144286 | AGGCCCUGGACAAAUGCCC | 880 | 3672-3690 |
| AD-71866 | A-144287 | UUGGCCUCUUCACCCUAGA | 567 | 3690-3708 | A-144288 | UCUAGGGUGAAGAGGCCAA | 881 | 3690-3708 |
| AD-71867 | A-144289 | AGAGGAGCUACACUAUUCA | 568 | 3706-3724 | A-144290 | UGAAUAGUGUAGCUCCUCU | 882 | 3706-3724 |
| AD-71868 | A-144291 | CCCCGAGGGGAGCCUGCAA | 569 | 3724-3742 | A-144292 | UUGCAGGCUCCCCUCGGGG | 883 | 3724-3742 |
| AD-71869 | A-144293 | CACACCCGUGGCCCUAGCA | 570 | 3740-3758 | A-144294 | UGCUAGGGCCACGGGUGUG | 884 | 3740-3758 |
| AD-71870 | A-144295 | ACCUACAAGAUCCCGGCAU | 571 | 3758-3776 | A-144296 | AUGCCGGGAUCUUGUAGGU | 885 | 3758-3776 |
| AD-71871 | A-144297 | UUUGGCAGCAUCCCCAUUA | 572 | 3776-3794 | A-144298 | UAAUGGGGAUGCUGCCAAA | 886 | 3776-3794 |
| AD-71872 | A-144301 | CCUGCUCCGCGACUGCCCA | 573 | 3808-3826 | A-144302 | UGGGCAGUCGCGGAGCAGG | 887 | 3808-3826 |
| AD-71873 | A-144303 | CAACAAGAAGGCCAUCUAU | 574 | 3826-3844 | A-144304 | AUAGAUGGCCUUCUUGUUG | 888 | 3826-3844 |
| AD-71874 | A-144305 | UAUGCAUCGAAGGCUGUUA | 575 | 3842-3860 | A-144306 | UAACAGCCUUCGAUGCAUA | 889 | 3842-3860 |
| AD-71875 | A-144307 | UGGAGAGCCGCCCCUCUUA | 576 | 3859-3877 | A-144308 | UAAGAGGGGCGGCUCUCCA | 890 | 3859-3877 |
| AD-71876 | A-144309 | UCCUGGCUGCUUCUAUCUU | 577 | 3876-3894 | A-144310 | AAGAUAGAAGCAGCCAGGA | 891 | 3876-3894 |
| AD-71877 | A-144311 | UUCUUUGCCAUCAAAGAUA | 578 | 3893-3911 | A-144312 | UAUCUUUGAUGGCAAAGAA | 892 | 3893-3911 |
| AD-71878 | A-144313 | CCAUCCGUGCAGCUCGAGA | 579 | 3912-3930 | A-144314 | UCUCGAGCUGCACGGAUGG | 893 | 3912-3930 |
| AD-71879 | A-144315 | AGCUCAGCACACAGGUAAU | 580 | 3928-3946 | A-144316 | AUUACCUGUGUGCUGAGCU | 894 | 3928-3946 |
| AD-71880 | A-144317 | AAUAACGUGAAGGAACUCU | 581 | 3944-3962 | A-144318 | AGAGUUCCUUCACGUUAUU | 895 | 3944-3962 |
| AD-71881 | A-144319 | UUCCGGCUAGACAGCCCUA | 582 | 3962-3980 | A-144320 | UAGGGCUGUCUAGCCGGAA | 896 | 3962-3980 |
| AD-71882 | A-144321 | UGCCACCCCGGAGAAGAUA | 583 | 3979-3997 | A-144322 | UAUCUUCUCCGGGGUGGCA | 897 | 3979-3997 |
| AD-71883 | A-144323 | AUCCGCAAUGCCUGCGUGA | 584 | 3995-4013 | A-144324 | UCACGCAGGCAUUGCGGAU | 898 | 3995-4013 |

TABLE 6-continued

XDH Unmodified Sequences

| Duplex Name | Sense Oligo Name | Sense Sequence (5' to 3') | SEQ ID NO | Position in NM_000379.3 | Antisense Oligo Name | Antisense Sequence (5'-3') | SEQ ID NO | Position in NM_000379.3 |
|---|---|---|---|---|---|---|---|---|
| AD-71884 | A-144325 | GACAAGUUCACCACCCUGU | 585 | 4013-4031 | A-144326 | ACAGGGUGGUGAACUUGUC | 899 | 4013-4031 |
| AD-71885 | A-144327 | UGUGUGUCACUGGUGUCCA | 586 | 4029-4047 | A-144328 | UGGACACCAGUGACACACA | 900 | 4029-4047 |
| AD-71886 | A-144329 | AGAAAACUGCAAACCCUGA | 587 | 4048-4066 | A-144330 | UCAGGGUUUGCAGUUUUCU | 901 | 4048-4066 |
| AD-71887 | A-144331 | CUGGUCUGUGAGGGUCUAA | 588 | 4063-4081 | A-144332 | UUAGACCCUCACAGACCAG | 902 | 4063-4081 |
| AD-71888 | A-144333 | AAAGAGAGAGUCCUCAGCA | 589 | 4080-4098 | A-144334 | UGCUGAGGACUCUCUCUUU | 903 | 4080-4098 |
| AD-71889 | A-144335 | AGAGUCUUCUUGUGCUGCA | 590 | 4098-4116 | A-144336 | UGCAGCACAAGAAGACUCU | 904 | 4098-4116 |
| AD-71890 | A-144337 | GCCUUUGGGCUUCCAUGGA | 591 | 4114-4132 | A-144338 | UCCAUGGAAGCCCAAAGGC | 905 | 4114-4132 |
| AD-71891 | A-144341 | CAGAACAUGGAUCUAUUAA | 592 | 4150-4168 | A-144342 | UUAAUAGAUCCAUGUUCUG | 906 | 4150-4168 |
| AD-71892 | A-144343 | UUAAAGUCACAGAAUGACA | 593 | 4165-4183 | A-144344 | UGUCAUUCUGUGACUUUAA | 907 | 4165-4183 |
| AD-71893 | A-144345 | AGACCUGUGAUUUGUCAAA | 594 | 4183-4201 | A-144346 | UUUGACAAAUCACAGGUCU | 908 | 4183-4201 |
| AD-71894 | A-144347 | AGAUGGGAUUUGGAAGACA | 595 | 4200-4218 | A-144348 | UGUCUUCCAAAUCCCAUCU | 909 | 4200-4218 |
| AD-71895 | A-144349 | AAGUGAAUGCAAUGGAAGA | 596 | 4218-4236 | A-144350 | UCUUCCAUUGCAUUCACUU | 910 | 4218-4236 |
| AD-71896 | A-144351 | AAGAUUUUGAUCAAAAAUA | 597 | 4233-4251 | A-144352 | UAUUUUGAUCAAAAUCUU | 911 | 4233-4251 |
| AD-71897 | A-144353 | UGUAAUUUGUAAACACAAU | 598 | 4250-4268 | A-144354 | AUUGUGUUUACAAAUUACA | 912 | 4250-4268 |
| AD-71898 | A-144355 | GAUAAGCAAAUUCAAAACU | 599 | 4269-4287 | A-144356 | AGUUUUGAAUUUGCUUAUC | 913 | 4269-4287 |
| AD-71899 | A-144357 | ACUGUUAUGCCUAAAUGGU | 600 | 4285-4303 | A-144358 | ACCAUUUAGGCAUAACAGU | 914 | 4285-4303 |
| AD-71900 | A-144359 | UGAAUAUGCAAUUAGGAUA | 601 | 4303-4321 | A-144360 | UAUCCUAAUUGCAUAUUCA | 915 | 4303-4321 |
| AD-71901 | A-144361 | AUCAUUUUCUGUCUGUUUU | 602 | 4319-4337 | A-144362 | AAAACAGACAGAAAAUGAU | 916 | 4319-4337 |
| AD-71902 | A-144363 | UUAAUCAUGUAUCUGGAAU | 603 | 4336-4354 | A-144364 | AUUCCAGAUACAUGAUUAA | 917 | 4336-4354 |
| AD-71903 | A-144365 | AAUAGGGUCGGGAAGGGUU | 604 | 4352-4370 | A-144366 | AACCCUUCCCGACCCUAUU | 918 | 4352-4370 |
| AD-71904 | A-144367 | UUUGUGCUAUUCCCCACUU | 605 | 4369-4387 | A-144368 | AAGUGGGGAAUAGCACAAA | 919 | 4369-4387 |
| AD-71905 | A-144369 | UUACUGGACAGCCUGUAUA | 606 | 4386-4404 | A-144370 | UAUACAGGCUGUCCAGUAA | 920 | 4386-4404 |
| AD-71906 | A-144371 | AACCUCAAGUUCUGAUGGU | 607 | 4404-4422 | A-144372 | ACCAUCAGAACUUGAGGUU | 921 | 4404-4422 |
| AD-71907 | A-144373 | UGUCUGUCCUUUGAAGAGA | 608 | 4422-4440 | A-144374 | UCUCUUCAAAGGACAGACA | 922 | 4422-4440 |
| AD-71908 | A-144375 | AGGAUUCCCACAAACCUCU | 609 | 4438-4456 | A-144376 | AGAGGUUUGUGGGAAUCCU | 923 | 4438-4456 |
| AD-71909 | A-144377 | UAGAAGCUUAAACCGAAGU | 610 | 4456-4474 | A-144378 | ACUUCGGUUUAAGCUUCUA | 924 | 4456-4474 |
| AD-71910 | A-144379 | AAGUUACUUUAAAUCGUGU | 611 | 4471-4489 | A-144380 | ACACGAUUUAAAGUAACUU | 925 | 4471-4489 |
| AD-71911 | A-144381 | UGCCUUCCUGUGAAAGCCU | 612 | 4489-4507 | A-144382 | AGGCUUUCACAGGAAGGCA | 926 | 4489-4507 |
| AD-71912 | A-144383 | CUGGCCUUCAAACCAAUGA | 613 | 4506-4524 | A-144384 | UCAUUGGUUUGAAGGCCAG | 927 | 4506-4524 |
| AD-71913 | A-144385 | AACAGCAAAGCAUAACCUU | 614 | 4524-4542 | A-144386 | AAGGUUAUGCUUUGCUGUU | 928 | 4524-4542 |
| AD-71914 | A-144387 | UUGAAUCUAUACUCAAAUU | 615 | 4541-4559 | A-144388 | AAUUUGAGUAUAGAUUCAA | 929 | 4541-4559 |
| AD-71915 | A-144389 | UUUUGCAAUGAGGCAGUGA | 616 | 4558-4576 | A-144390 | UCACUGCCUCAUUGCAAAA | 930 | 4558-4576 |
| AD-71916 | A-144391 | UGGGGUAAGGUUAAAUCCU | 617 | 4574-4592 | A-144392 | AGGAUUUAACCUUACCCCA | 931 | 4574-4592 |
| AD-71917 | A-144393 | UCUAACCAUCUUUGAAUCA | 618 | 4592-4610 | A-144394 | UGAUUCAAAGAUGGUUAGA | 932 | 4592-4610 |
| AD-71918 | A-144395 | AUCAUUGGAAAGAAUAAAG | 619 | 4607-4625 | A-144396 | CUUUAUUCUUUCCAAUGAU | 933 | 4607-4625 |
| AD-71919 | A-144397 | AAUGAAACAAAUUCAAGGU | 620 | 4626-4644 | A-144398 | ACCUUGAAUUUGUUUCAUU | 934 | 4626-4644 |
| AD-71920 | A-144399 | AGGUUAAUUGGAUCUGAUU | 621 | 4641-4659 | A-144400 | AAUCAGAUCCAAUUAACCU | 935 | 4641-4659 |

TABLE 6-continued

XDH Unmodified Sequences

| Duplex Name | Sense Oligo Name | Sense Sequence (5' to 3') | SEQ ID NO | Position in NM_000379.3 | Antisense Oligo Name | Antisense Sequence (5'-3') | SEQ ID NO | Position in NM_000379.3 |
|---|---|---|---|---|---|---|---|---|
| AD-71921 | A-144401 | UUUGUGAAGCUGCAUAAAG | 622 | 4659-4677 | A-144402 | CUUUAUGCAGCUUCACAAA | 936 | 4659-4677 |
| AD-71922 | A-144403 | AGCAAGAUUACUCUAUAAU | 623 | 4676-4694 | A-144404 | AUUAUAGAGUAAUCUUGCU | 937 | 4676-4694 |
| AD-71923 | A-144405 | UACAAAAAUCCAACCAACU | 624 | 4694-4712 | A-144406 | AGUUGGUUGGAUUUUUGUA | 938 | 4694-4712 |
| AD-71924 | A-144407 | ACUCAAUUAUUGAGCACGU | 625 | 4710-4728 | A-144408 | ACGUGCUCAAUAAUUGAGU | 939 | 4710-4728 |
| AD-71925 | A-144409 | UACAAUGUUCUAGAUUUCU | 626 | 4728-4746 | A-144410 | AGAAAUCUAGAACAUUGUA | 940 | 4728-4746 |
| AD-71926 | A-144411 | UUCUUUCCCUUCCUCUUUA | 627 | 4743-4761 | A-144412 | UAAAGAGGAAGGGAAAGAA | 941 | 4743-4761 |
| AD-71927 | A-144413 | GAAGAGAAUAUUUGUAUUA | 628 | 4761-4779 | A-144414 | UAAUACAAAUAUUCUCUUC | 942 | 4761-4779 |
| AD-71928 | A-144415 | UUCCAAAUACUCUUUGAGU | 629 | 4777-4795 | A-144416 | ACUCAAAGAGUAUUUGGAA | 943 | 4777-4795 |
| AD-71929 | A-144417 | UAUUUACAAAAAGAUUAU | 630 | 4795-4813 | A-144418 | AUAAUCUUUUUGUAAAUA | 944 | 4795-4813 |
| AD-72020 | A-144419 | UAUGUUUAAUCUUUACAUU | 631 | 4811-4829 | A-144420 | AAUGUAAAGAUUAAACAUA | 945 | 4811-4829 |
| AD-72021 | A-144421 | UUUGAAGCCAAAGUAAUUU | 632 | 4828-4846 | A-144422 | AAAUUACUUUGGCUUCAAA | 946 | 4828-4846 |
| AD-72022 | A-144423 | UUCCACCUAGAAAUGAUGA | 633 | 4845-4863 | A-144424 | UCAUCAUUUCUAGGUGGAA | 947 | 4845-4863 |
| AD-72023 | A-144425 | UAUCAGUCCUGGCAUGGUA | 634 | 4864-4882 | A-144426 | UACCAUGCCAGGACUGAUA | 948 | 4864-4882 |
| AD-72024 | A-144427 | UGGCUCACCCCUAUAAUCA | 635 | 4881-4899 | A-144428 | UGAUUAUAGGGGUGAGCCA | 949 | 4881-4899 |
| AD-72025 | A-144429 | AUCCCAGCACUUUGGGAGA | 636 | 4896-4914 | A-144430 | UCUCCCAAAGUGCUGGGAU | 950 | 4896-4914 |
| AD-72026 | A-144431 | CUAAGGCAGGAGAAUUGCU | 637 | 4915-4933 | A-144432 | AGCAAUUCUCCUGCCUUAG | 951 | 4915-4933 |
| AD-72027 | A-144433 | UGCUUGAGCCCAGCAGUUU | 638 | 4930-4948 | A-144434 | AAACUGCUGGGCUCAAGCA | 952 | 4930-4948 |
| AD-72028 | A-144435 | UUGAGACCAGCCUGGGCAA | 639 | 4947-4965 | A-144436 | UUGCCCAGGCUGGUCUCAA | 953 | 4947-4965 |
| AD-72029 | A-144437 | ACAUAGAGAGCUCCUGUCU | 640 | 4965-4983 | A-144438 | AGACAGGAGCUCUCUAUGU | 954 | 4965-4983 |
| AD-72030 | A-144439 | UCUUUAAAAAAAUUUUUU | 641 | 4981-4999 | A-144440 | AAAAAAUUUUUUUAAAGA | 955 | 4981-4999 |
| AD-72031 | A-144441 | UUAAUUAGUUGGUCUUGAU | 642 | 4999-5017 | A-144442 | AUCAAGACCAACUAAUUAA | 956 | 4999-5017 |
| AD-72032 | A-144443 | UAGUGCAUGCCUGUAGUCA | 643 | 5017-5035 | A-144444 | UGACUACAGGCAUGCACUA | 957 | 5017-5035 |
| AD-72033 | A-144445 | CCCAACUACUUGAAAGGCU | 644 | 5034-5052 | A-144446 | AGCCUUUCAAGUAGUUGGG | 958 | 5034-5052 |
| AD-72034 | A-144447 | CUGAGGUGGAGAGAUCAUU | 645 | 5051-5069 | A-144448 | AAUGAUCUCUCCACCUCAG | 959 | 5051-5069 |
| AD-72035 | A-144449 | UUUGAGCUCAGGAGGUUGA | 646 | 5068-5086 | A-144450 | UCAACCUCCUGAGCUCAAA | 960 | 5068-5086 |
| AD-72036 | A-144451 | UUGAGGCUGCAGUGAGCUA | 647 | 5083-5101 | A-144452 | UAGCUCACUGCAGCCUCAA | 961 | 5083-5101 |
| AD-72037 | A-144455 | CUCCUGCCUGAGCGACUGA | 648 | 5118-5136 | A-144456 | UCAGUCGCUCAGGCAGGAG | 962 | 5118-5136 |
| AD-72038 | A-144457 | UGAGCAAGAUCUUGUCUCU | 649 | 5134-5152 | A-144458 | AGAGACAAGAUCUUGCUCA | 963 | 5134-5152 |
| AD-72039 | A-144459 | UGAAGAAAAAAAAGAAAU | 650 | 5152-5170 | A-144460 | AUUUCUUUUUUUUCUUCA | 964 | 5152-5170 |
| AD-72040 | A-144461 | UAAAAAUGCUGCUAUCAAA | 651 | 5170-5188 | A-144462 | UUUGAUAGCAGCAUUUUUA | 965 | 5170-5188 |
| AD-72041 | A-144463 | AAAAUCAAGCCCAACCAGA | 652 | 5186-5204 | A-144464 | UCUGGUUGGGCUUGAUUUU | 966 | 5186-5204 |
| AD-72042 | A-144465 | AGAGGUAGAAGAGCCAAGA | 653 | 5202-5220 | A-144466 | UCUUGGCUCUUCUACCUCU | 967 | 5202-5220 |
| AD-72043 | A-144467 | AAGCCUGGGUUCUCAUCCU | 654 | 5220-5238 | A-144468 | AGGAUGAGAACCCAGGCUU | 968 | 5220-5238 |
| AD-72044 | A-144469 | CUAGCUCUGUCUCUUCUGU | 655 | 5237-5255 | A-144470 | ACAGAAGAGACAGAGCUAG | 969 | 5237-5255 |
| AD-72045 | A-144473 | UUGGACUGUCAAUUCCCCU | 656 | 5272-5290 | A-144474 | AGGGGAAUUGACAGUCCAA | 970 | 5272-5290 |
| AD-72046 | A-144475 | CCUUCCUGUGAUCCAUUUU | 657 | 5288-5306 | A-144476 | AAAAUGGAUCACAGGAAGG | 971 | 5288-5306 |
| AD-72047 | A-144481 | UCUCACGUCUUCUGCUUUA | 658 | 5339-5357 | A-144482 | UAAAGCAGAAGACGUGAGA | 972 | 5339-5357 |

TABLE 6-continued

XDH Unmodified Sequences

| Duplex Name | Sense Oligo Name | Sense Sequence (5' to 3') | SEQ ID NO | Position in NM_000379.3 | Antisense Oligo Name | Antisense Sequence (5'-3') | SEQ ID NO | Position in NM_000379.3 |
|---|---|---|---|---|---|---|---|---|
| AD-72048 | A-144485 | UAUGACCUGAAAACUCCAA | 659 | 5372-5390 | A-144486 | UUGGAGUUUUCAGGUCAUA | 973 | 5372-5390 |
| AD-72049 | A-144487 | UUACAUAAAGGAUCUGCAA | 660 | 5391-5409 | A-144488 | UUGCAGAUCCUUUAUGUAA | 974 | 5391-5409 |
| AD-72050 | A-144489 | CAGCUAUCUAAGGCUUGGU | 661 | 5407-5425 | A-144490 | ACCAAGCCUUAGAUAGCUG | 975 | 5407-5425 |
| AD-72051 | A-144493 | AUGAUACCUGGGUCUAAUA | 662 | 5440-5458 | A-144494 | UAUUAGACCCAGGUAUCAU | 976 | 5440-5458 |
| AD-72052 | A-144495 | AACUCUGCUGAGAUCACCU | 663 | 5459-5477 | A-144496 | AGGUGAUCUCAGCAGAGUU | 977 | 5459-5477 |
| AD-72053 | A-144497 | ACCUCAAGUUUCUGCGGUU | 664 | 5474-5492 | A-144498 | AACCGCAGAAACUUGAGGU | 978 | 5474-5492 |
| AD-72054 | A-144499 | UUGGUAAAGAGAACAAGGA | 665 | 5491-5509 | A-144500 | UCCUUGUUCUCUUUACCAA | 979 | 5491-5509 |
| AD-72055 | A-144501 | AAGAACAAACAUCCCUUUU | 666 | 5510-5528 | A-144502 | AAAAGGGAUGUUUGUUCUU | 980 | 5510-5528 |
| AD-72056 | A-144503 | UUUUAUUGCUCCAAAUGGU | 667 | 5525-5543 | A-144504 | ACCAUUUGGAGCAAUAAAA | 981 | 5525-5543 |
| AD-72057 | A-144505 | GAUUUAAUCCCUACAUGGU | 668 | 5544-5562 | A-144506 | ACCAUGUAGGGAUUAAAUC | 982 | 5544-5562 |
| AD-72058 | A-144507 | GGUGCUGGGUGGACAAUGU | 669 | 5560-5578 | A-144508 | ACAUUGUCCACCCAGCACC | 983 | 5560-5578 |
| AD-72059 | A-144509 | UGUCACUGUCACAUGCCUU | 670 | 5578-5596 | A-144510 | AAGGCAUGUGACAGUGACA | 984 | 5578-5596 |
| AD-72060 | A-144511 | UUCACUGUAUAAAUCCAAA | 671 | 5595-5613 | A-144512 | UUUGGAUUUAUACAGUGAA | 985 | 5595-5613 |
| AD-72061 | A-144513 | ACCUUCUGCCAGAGAGAAU | 672 | 5612-5630 | A-144514 | AUUCUCUCUGGCAGAAGGU | 986 | 5612-5630 |
| AD-72062 | A-144517 | CAUGGAGGGAGGAUAGUGA | 673 | 5644-5662 | A-144518 | UCACUAUCCUCCCUCCAUG | 987 | 5644-5662 |
| AD-72063 | A-144519 | AAAUGAUAUAGUUGGACUA | 674 | 5663-5681 | A-144520 | UAGUCCAACUAUAUCAUUU | 988 | 5663-5681 |
| AD-72064 | A-144521 | ACUGGUGCUUGAUGUCACU | 675 | 5678-5696 | A-144522 | AGUGACAUCAAGCACCAGU | 989 | 5678-5696 |
| AD-72065 | A-144523 | CUAAUAAAUGAAACUGUCA | 676 | 5695-5713 | A-144524 | UGACAGUUUCAUUUAUUAG | 990 | 5695-5713 |

TABLE 7

XDH Modified Sequences

| Duplex Name | Sense Oligo Name | Sense OligoSeq | SEQ ID NO | Antisense Oligo Name | Antisense OligoSeq | SEQ ID NO | mRNA target sequence | SEQ ID NO |
|---|---|---|---|---|---|---|---|---|
| AD-71930 | A-143855 | ACUACCUGCCAGUGUCUCUdTdT | 991 | A-143856 | AGAGACACUGGCAGGUAGUdTdT | 1305 | ACUACCUGCCAGUGUCUCU | 1619 |
| AD-71931 | A-143857 | UUAGGAGUGAGGUACCUGAdTdT | 992 | A-143858 | UCAGGUACCUCACUCCUAAdTdT | 1306 | UUAGGAGUGAGGUACCUGG | 1620 |
| AD-71932 | A-143861 | AACCUGUGACAAUGACAGAdTdT | 993 | A-143862 | UCUGUCAUUGUCACAGGUUdTdT | 1307 | AACCUGUGACAAUGACAGC | 1621 |
| AD-71933 | A-143863 | GCAGACAAAUUGGUUUUCUdTdT | 994 | A-143864 | AGAAAACCAAUUUGUCUGCdTdT | 1308 | GCAGACAAAUUGGUUUUCU | 1622 |
| AD-71934 | A-143865 | UUUGUGAAUGGCAGAAAGAdTdT | 995 | A-143866 | UCUUUCUGCCAUUCACAAAdTdT | 1309 | UUUGUGAAUGGCAGAAAGG | 1623 |
| AD-71935 | A-143867 | AAGGUGGUGGAGAAAAAUAdTdT | 996 | A-143868 | UAUUUUUCUCCACCACCUUdTdT | 1310 | AAGGUGGUGGAGAAAAAUG | 1624 |
| AD-71936 | A-143871 | CCUUUUGGCCUACCUGAGAdTdT | 997 | A-143872 | UCUCAGGUAGGCCAAAAGGdTdT | 1311 | CCUUUUGGCCUACCUGAGA | 1625 |
| AD-71937 | A-143873 | AAGAAAGUUGGGGCUGAGUdTdT | 998 | A-143874 | ACUCAGCCCCAACUUUCUUdTdT | 1312 | AAGAAAGUUGGGGCUGAGU | 1626 |
| AD-71938 | A-143875 | AGUGGAACCAAGCUCGGCUdTdT | 999 | A-143876 | AGCCGAGCUUGGUUCCACUdTdT | 1313 | AGUGGAACCAAGCUCGGCU | 1627 |

TABLE 7-continued

XDH Modified Sequences

| Duplex Name | Sense Oligo Name | Sense OligoSeq | SEQ ID NO | Antisense Oligo Name | Antisense OligoSeq | SEQ ID NO | mRNA target sequence | SEQ ID NO |
| --- | --- | --- | --- | --- | --- | --- | --- | --- |
| AD-71939 | A-143877 | CUGUGGAGAGGGGGGCUGAdTdT | 1000 | A-143878 | UCAGCCCCCUCUCCACAGdTdT | 1314 | CUGUGGAGAGGGGGGCUGC | 1628 |
| AD-71940 | A-143879 | CGGGGCUUGCACAGUGAUdTdT | 1001 | A-143880 | UAUCACUGUGCAAGCCCCGdTdT | 1315 | CGGGGCUUGCACAGUGAUG | 1629 |
| AD-71941 | A-143881 | AUGCUCUCCAAGUAUGAUdTdT | 1002 | A-143882 | UAUCAUACUUGGAGAGCAUdTdT | 1316 | AUGCUCUCCAAGUAUGAUC | 1630 |
| AD-71942 | A-143885 | UCGUCCACUUUUCUGCCAAdTdT | 1003 | A-143886 | UUGGCAGAAAAGUGGACGAdTdT | 1317 | UCGUCCACUUUUCUGCCAA | 1631 |
| AD-71943 | A-143887 | AUGCCUGCCUGGCCCCCAUdTdT | 1004 | A-143888 | AUGGGGGCCAGGCAGGCAUdTdT | 1318 | AUGCCUGCCUGGCCCCCAU | 1632 |
| AD-71944 | A-143889 | AUCUGCUCCUUGCACCAUdTdT | 1005 | A-143890 | UAUGGUGCAAGGAGCAGAdTdT | 1319 | AUCUGCUCCUUGCACCAUG | 1633 |
| AD-71945 | A-143891 | UGUUGCAGUGACAACUGUAdTdT | 1006 | A-143892 | UACAGUUGUCACUGCAACAdTdT | 1320 | UGUUGCAGUGACAACUGUG | 1634 |
| AD-71946 | A-143893 | UGGAAGGAAUAGGAAGCAAdTdT | 1007 | A-143894 | UUGCUUCCUAUUCCUUCCAdTdT | 1321 | UGGAAGGAAUAGGAAGCAC | 1635 |
| AD-71947 | A-143895 | CACCAAGACGAGGCUGCAUdTdT | 1008 | A-143896 | AUGCAGCCUCGUCUUGGUGdTdT | 1322 | CACCAAGACGAGGCUGCAU | 1636 |
| AD-71948 | A-143897 | UCCUGUGCAGGAGAGAAUUdTdT | 1009 | A-143898 | AAUUCUCUCCUGCACAGGAdTdT | 1323 | UCCUGUGCAGGAGAGAAUU | 1637 |
| AD-71949 | A-143899 | AUUGCCAAAAGCCACGGCUdTdT | 1010 | A-143900 | AGCCGUGGCUUUUGGCAAUdTdT | 1324 | AUUGCCAAAAGCCACGGCU | 1638 |
| AD-71950 | A-143901 | UCCCAGUGCGGGUUCUGCAdTdT | 1011 | A-143902 | UGCAGAACCCGCACUGGGAdTdT | 1325 | UCCCAGUGCGGGUUCUGCA | 1639 |
| AD-71951 | A-143903 | UGCACCCCUGGCAUCGUCAdTdT | 1012 | A-143904 | UGACGAUGCCAGGGGUGCAdTdT | 1326 | UGCACCCCUGGCAUCGUCA | 1640 |
| AD-71952 | A-143905 | UGAGUAUGUACACACUGCUdTdT | 1013 | A-143906 | AGCAGUGUGUACAUACUCAdTdT | 1327 | UGAGUAUGUACACACUGCU | 1641 |
| AD-71953 | A-143907 | UGCUCCGGAAUCAGCCCGAdTdT | 1014 | A-143908 | UCGGGCUGAUUCCGGAGCAdTdT | 1328 | UGCUCCGGAAUCAGCCCGA | 1642 |
| AD-71954 | A-143909 | AGCCCACCAUGGAGGAGAUdTdT | 1015 | A-143910 | AUCUCCUCCAUGGUGGGCUdTdT | 1329 | AGCCCACCAUGGAGGAGAU | 1643 |
| AD-71955 | A-143911 | UUGAGAAUGCCUUCCAAGAdTdT | 1016 | A-143912 | UCUUGGAAGGCAUUCUCAAdTdT | 1330 | UUGAGAAUGCCUUCCAAGG | 1644 |
| AD-71956 | A-143913 | AAGGAAAUCUGUGCCGCUAdTdT | 1017 | A-143914 | UAGCGGCACAGAUUUCCUUdTdT | 1331 | AAGGAAAUCUGUGCCGCUG | 1645 |
| AD-71957 | A-143915 | CACAGGCUACAGACCCAUdTdT | 1018 | A-143916 | UAUGGGUCUGUAGCCUGUGdTdT | 1332 | CACAGGCUACAGACCCAUC | 1646 |
| AD-71958 | A-143917 | CAUCCUCCAGGGCUUCCGAdTdT | 1019 | A-143918 | UCGGAAGCCCUGGAGGAUGdTdT | 1333 | CAUCCUCCAGGGCUUCCGG | 1647 |
| AD-71959 | A-143919 | ACCUUUGCCAGGGAUGGUAdTdT | 1020 | A-143920 | UACCAUCCCUGGCAAAGGUdTdT | 1334 | ACCUUUGCCAGGGAUGGUG | 1648 |
| AD-71960 | A-143921 | UGGAUGCUGUGGAGGAGAUdTdT | 1021 | A-143922 | AUCUCCUCCACAGCAUCCAdTdT | 1335 | UGGAUGCUGUGGAGGAGAU | 1649 |
| AD-71961 | A-143923 | GAUGGGAAUAAUCCAAAUUdTdT | 1022 | A-143924 | AAUUUGGAUUAUUCCCAUCdTdT | 1336 | GAUGGGAAUAAUCCAAAUU | 1650 |
| AD-71962 | A-143927 | AGAAAGACCACUCAGUCAAdTdT | 1023 | A-143928 | UUGACUGAGUGGUCUUUCUdTdT | 1337 | AGAAAGACCACUCAGUCAG | 1651 |

TABLE 7-continued

XDH Modified Sequences

| Duplex Name | Sense Oligo Name | Sense OligoSeq | SEQ ID NO | Antisense Oligo Name | Antisense OligoSeq | SEQ ID NO | mRNA target sequence | SEQ ID NO |
|---|---|---|---|---|---|---|---|---|
| AD-71963 | A-143929 | AGCCUCUCGCCAUCUUUAUdTdT | 1024 | A-143930 | AUAAAGAUGGCGAGAGGCUdTdT | 1338 | AGCCUCUCGCCAUCUUUAU | 1652 |
| AD-71964 | A-143931 | UAUUCAAACCAGAGGAGUUdTdT | 1025 | A-143932 | AACUCCUCUGGUUUGAAUAdTdT | 1339 | UAUUCAAACCAGAGGAGUU | 1653 |
| AD-71965 | A-143933 | UUCACGCCCCUGGAUCCAAdTdT | 1026 | A-143934 | UUGGAUCCAGGGGCGUGAAdTdT | 1340 | UUCACGCCCCUGGAUCCAA | 1654 |
| AD-71966 | A-143935 | AACCCAGGAGCCCAUUUUUdTdT | 1027 | A-143936 | AAAAAUGGGCUCCUGGGUUdTdT | 1341 | AACCCAGGAGCCCAUUUUU | 1655 |
| AD-71967 | A-143937 | UUCCCCCAGAGUUGCUGAAdTdT | 1028 | A-143938 | UUCAGCAACUCUGGGGGAAdTdT | 1342 | UUCCCCCAGAGUUGCUGAG | 1656 |
| AD-71968 | A-143939 | AGGCUGAAAGACACUCCUAdTdT | 1029 | A-143940 | UAGGAGUGUCUUUCAGCCUdTdT | 1343 | AGGCUGAAAGACACUCCUC | 1657 |
| AD-71969 | A-143941 | UCGGAAGCAGCUGCGAUUUdTdT | 1030 | A-143942 | AAAUCGCAGCUGCUUCCGAdTdT | 1344 | UCGGAAGCAGCUGCGAUUU | 1658 |
| AD-71970 | A-143943 | UUGAAGGGGAGCGUGUGAAdTdT | 1031 | A-143944 | UUCACACGCUCCCCUUCAAdTdT | 1345 | UUGAAGGGGAGCGUGUGAC | 1659 |
| AD-71971 | A-143945 | CGUGGAUACAGGCCUCAAAdTdT | 1032 | A-143946 | UUUGAGGCCUGUAUCCACGdTdT | 1346 | CGUGGAUACAGGCCUCAAC | 1660 |
| AD-71972 | A-143947 | AACCCUCAAGGAGCUGCUAdTdT | 1033 | A-143948 | UAGCAGCUCCUUGAGGGUUdTdT | 1347 | AACCCUCAAGGAGCUGCUG | 1661 |
| AD-71973 | A-143949 | UGGACCUCAAGGCUCAGCAdTdT | 1034 | A-143950 | UGCUGAGCCUUGAGGUCCAdTdT | 1348 | UGGACCUCAAGGCUCAGCA | 1662 |
| AD-71974 | A-143951 | ACCCUGACGCCAAGCUGGUdTdT | 1035 | A-143952 | ACCAGCUUGGCGUCAGGGUdTdT | 1349 | ACCCUGACGCCAAGCUGGU | 1663 |
| AD-71975 | A-143953 | UCGUGGGAACACGGAGAUdTdT | 1036 | A-143954 | AUCUCCGUGUUCCCCACGAdTdT | 1350 | UCGUGGGGAACACGGAGAU | 1664 |
| AD-71976 | A-143955 | AUUGGCAUUGAGAUGAAGUdTdT | 1037 | A-143956 | ACUUCAUCUCAAUGCCAAUdTdT | 1351 | AUUGGCAUUGAGAUGAAGU | 1665 |
| AD-71977 | A-143957 | AAGUUCAAGAAUAUGCUGUdTdT | 1038 | A-143958 | ACAGCAUAUUCUUGAACUUdTdT | 1352 | AAGUUCAAGAAUAUGCUGU | 1666 |
| AD-71978 | A-143959 | UUUCCUAUGAUUGUCUGCAdTdT | 1039 | A-143960 | UGCAGACAAUCAUAGGAAAdTdT | 1353 | UUUCCUAUGAUUGUCUGCC | 1667 |
| AD-71979 | A-143961 | CCCAGCCUGGAUCCCUGAAdTdT | 1040 | A-143962 | UUCAGGGAUCCAGGCUGGGdTdT | 1354 | CCCAGCCUGGAUCCCUGAG | 1668 |
| AD-71980 | A-143963 | AGCUGAAUUCGGUAGAACAdTdT | 1041 | A-143964 | UGUUCUACCGAAUUCAGCUdTdT | 1355 | AGCUGAAUUCGGUAGAACA | 1669 |
| AD-71981 | A-143965 | CAUGGACCCGACGGUAUCUdTdT | 1042 | A-143966 | AGAUACCGUCGGGUCCAUGdTdT | 1356 | CAUGGACCCGACGGUAUCU | 1670 |
| AD-71982 | A-143967 | UCUCCUUGGAGCUGCUUAdTdT | 1043 | A-143968 | UAAGCAGCUCCAAAGGAGAdTdT | 1357 | UCUCCUUGGAGCUGCUUG | 1671 |
| AD-71983 | A-143969 | UGCCCCCUGAGCAUUGUGAdTdT | 1044 | A-143970 | UCACAAUGCUCAGGGGGCAdTdT | 1358 | UGCCCCCUGAGCAUUGUGG | 1672 |
| AD-71984 | A-143971 | AAAAAACCCUGGUGGAUGAdTdT | 1045 | A-143972 | UCAUCCACCAGGGUUUUUUdTdT | 1359 | AAAAAACCCUGGUGGAUGC | 1673 |
| AD-71985 | A-143973 | UGCUGUUGCUAAGCUUCCUdTdT | 1046 | A-143974 | AGGAAGCUUAGCAACAGCAdTdT | 1360 | UGCUGUUGCUAAGCUUCCU | 1674 |
| AD-71986 | A-143975 | CCUGCCCAAAAGACAGAGAdTdT | 1047 | A-143976 | UCUCUGUCUUUUGGGCAGGdTdT | 1361 | CCUGCCCAAAAGACAGAGG | 1675 |

TABLE 7-continued

XDH Modified Sequences

| Duplex Name | Sense Oligo Name | Sense OligoSeq | SEQ ID NO | Antisense Oligo Name | Antisense OligoSeq | SEQ ID NO | mRNA target sequence | SEQ ID NO |
|---|---|---|---|---|---|---|---|---|
| AD-71987 | A-143977 | UGUUCAGAGGGGUCCUGGAdTdT | 1048 | A-143978 | UCCAGGACCCCUCUGAACAdTdT | 1362 | UGUUCAGAGGGGUCCUGGA | 1676 |
| AD-71988 | A-143979 | UGGAGCAGCUGCGCUGGUUdTdT | 1049 | A-143980 | AACCAGCGCAGCUGCUCCAdTdT | 1363 | UGGAGCAGCUGCGCUGGUU | 1677 |
| AD-71989 | A-143981 | UUUGCUGGGAAGCAAGUCAdTdT | 1050 | A-143982 | UGACUUGCUUCCCAGCAAAdTdT | 1364 | UUUGCUGGGAAGCAAGUCA | 1678 |
| AD-71990 | A-143983 | CAAGUCUGUGGCGUCCGUUdTdT | 1051 | A-143984 | AACGGACGCCACAGACUUGdTdT | 1365 | CAAGUCUGUGGCGUCCGUU | 1679 |
| AD-71991 | A-143985 | UGGAGGGAACAUCAUCACUdTdT | 1052 | A-143986 | AGUGAUGAUGUUCCCUCCAdTdT | 1366 | UGGAGGGAACAUCAUCACU | 1680 |
| AD-71992 | A-143987 | UGCCAGCCCCAUCUCCGAAdTdT | 1053 | A-143988 | UUCGGAGAUGGGGCUGGCAdTdT | 1367 | UGCCAGCCCCAUCUCCGAC | 1681 |
| AD-71993 | A-143989 | ACCUCAACCCCGUGUUCAUdTdT | 1054 | A-143990 | AUGAACACGGGGUUGAGGUdTdT | 1368 | ACCUCAACCCCGUGUUCAU | 1682 |
| AD-71994 | A-143991 | UCAUGGCCAGUGGGGCCAAdTdT | 1055 | A-143992 | UUGGCCCCACUGGCCAUGAdTdT | 1369 | UCAUGGCCAGUGGGGCCAA | 1683 |
| AD-71995 | A-143993 | AAGCUGACACUUGUGUCCAdTdT | 1056 | A-143994 | UGGACACAAGUGUCAGCUUdTdT | 1370 | AAGCUGACACUUGUGUCCA | 1684 |
| AD-71996 | A-143995 | CAGAGGCACCAGGAGAACUdTdT | 1057 | A-143996 | AGUUCUCCUGGUGCCUCUGdTdT | 1371 | CAGAGGCACCAGGAGAACU | 1685 |
| AD-71997 | A-143997 | UGUCCAGAUGGACCACACCdTdT | 1058 | A-143998 | UGUGUGGUCCAUCUGGACAdTdT | 1372 | UGUCCAGAUGGACCACACC | 1686 |
| AD-71998 | A-143999 | CCUUCUUCCCUGGCUACAGdTdT | 1059 | A-144000 | UUGUAGCCAGGGAAGAAGGdTdT | 1373 | CCUUCUUCCCUGGCUACAG | 1687 |
| AD-71999 | A-144001 | AGAAAGACCCUGCUGAGCAdTdT | 1060 | A-144002 | UGCUCAGCAGGGUCUUUCUdTdT | 1374 | AGAAAGACCCUGCUGAGCC | 1688 |
| AD-72000 | A-144003 | CCGGAGGAGAUACUGCUCUdTdT | 1061 | A-144004 | AGAGCAGUAUCUCCUCCGGdTdT | 1375 | CCGGAGGAGAUACUGCUCU | 1689 |
| AD-72001 | A-144005 | CUCUCCAUAGAGAUCCCUdTdT | 1062 | A-144006 | AGGGGAUCUCUAUGGAGAGdTdT | 1376 | CUCUCCAUAGAGAUCCCU | 1690 |
| AD-72002 | A-144007 | UACAGCAGGGAGGGGAGUdTdT | 1063 | A-144008 | ACUCCCCCUCCCUGCUGUAdTdT | 1377 | UACAGCAGGGAGGGGAGU | 1691 |
| AD-72003 | A-144009 | AGUAUUUCUCAGCAUUCAAdTdT | 1064 | A-144010 | UUGAAUGCUGAGAAAUACUdTdT | 1378 | AGUAUUUCUCAGCAUUCAA | 1692 |
| AD-72004 | A-144011 | AAGCAGGCCUCCCGGAGAAdTdT | 1065 | A-144012 | UUCUCCGGGAGGCCUGCUUdTdT | 1379 | AAGCAGGCCUCCCGGAGAG | 1693 |
| AD-72005 | A-144013 | AAGAUGACAUUGCCAAGGUdTdT | 1066 | A-144014 | ACCUUGGCAAUGUCAUCUUdTdT | 1380 | AAGAUGACAUUGCCAAGGU | 1694 |
| AD-72006 | A-144015 | GGUAACCAGUGGCAUGAGAdTdT | 1067 | A-144016 | UCUCAUGCCACUGGUUACCdTdT | 1381 | GGUAACCAGUGGCAUGAGA | 1695 |
| AD-72007 | A-144017 | AGAGUUUAUUCAAGCCAAdTdT | 1068 | A-144018 | UUGGCUUGAAUAAACUCUdTdT | 1382 | AGAGUUUAUUCAAGCCAG | 1696 |
| AD-72008 | A-144019 | AGGAACCACAGAGGUACAAdTdT | 1069 | A-144020 | UUGUACCUCUGUGGUUCCUdTdT | 1383 | AGGAACCACAGAGGUACAG | 1697 |
| AD-72009 | A-144021 | AGGAGCUGGCCCUUUGCUAdTdT | 1070 | A-144022 | UAGCAAAGGGCCAGCUCCUdTdT | 1384 | AGGAGCUGGCCCUUUGCUA | 1698 |
| AD-72010 | A-144023 | UAUGGUGGAAUGGCCAACAdTdT | 1071 | A-144024 | UGUUGGCCAUUCCACCAUAdTdT | 1385 | UAUGGUGGAAUGGCCAACA | 1699 |

TABLE 7-continued

XDH Modified Sequences

| Duplex Name | Sense Oligo Name | Sense OligoSeq | SEQ ID NO | Antisense Oligo Name | Antisense OligoSeq | SEQ ID NO | mRNA target sequence | SEQ ID NO |
|---|---|---|---|---|---|---|---|---|
| AD-72011 | A-144025 | AGAACCAUCUCAGCCCUCAdTdT | 1072 | A-144026 | UGAGGGCUGAGAUGGUUCUdTdT | 1386 | AGAACCAUCUCAGCCCUCA | 1700 |
| AD-72012 | A-144027 | AAGACCACUCAGAGGCAGAdTdT | 1073 | A-144028 | UCUGCCUCUGAGUGGUCUUdTdT | 1387 | AAGACCACUCAGAGGCAGC | 1701 |
| AD-72013 | A-144029 | CAGCUUUCCAAGCUCUGGAdTdT | 1074 | A-144030 | UCCAGAGCUUGGAAAGCUGdTdT | 1388 | CAGCUUUCCAAGCUCUGGA | 1702 |
| AD-72014 | A-144031 | AGGAGGAGCUGCUGCAGGAdTdT | 1075 | A-144032 | UCCUGCAGCAGCUCCUCCUdTdT | 1389 | AGGAGGAGCUGCUGCAGGA | 1703 |
| AD-72015 | A-144033 | AGGACGUGUGUGCAGGACUdTdT | 1076 | A-144034 | AGUCCUGCACACACGUCCUdTdT | 1390 | AGGACGUGUGUGCAGGACU | 1704 |
| AD-72016 | A-144035 | UGGCAGAGGAGCUGCAUCUdTdT | 1077 | A-144036 | AGAUGCAGCUCCUCUGCCAdTdT | 1391 | UGGCAGAGGAGCUGCAUCU | 1705 |
| AD-72017 | A-144037 | UCUGCCUCCCGAUGCCCUdTdT | 1078 | A-144038 | AGGGGCAUCGGGAGGCAGAdTdT | 1392 | UCUGCCUCCCGAUGCCCU | 1706 |
| AD-72018 | A-144039 | GGUGGCAUGGUGGACUUCAdTdT | 1079 | A-144040 | UGAAGUCCACCAUGCCACCdTdT | 1393 | GGUGGCAUGGUGGACUUCC | 1707 |
| AD-72019 | A-144041 | UUCCGGUGCACCCUCACCAdTdT | 1080 | A-144042 | UGGUGAGGGUGCACCGGAAdTdT | 1394 | UUCCGGUGCACCCUCACCC | 1708 |
| AD-71752 | A-144043 | UCAGCUUCUUCUUCAAGUUdTdT | 1081 | A-144044 | AACUUGAAGAAGAAGCUGAdTdT | 1395 | UCAGCUUCUUCUUCAAGUU | 1709 |
| AD-71753 | A-144045 | UUCUACCUGACAGUCCUUAdTdT | 1082 | A-144046 | UAAGGACUGUCAGGUAGAAdTdT | 1396 | UUCUACCUGACAGUCCUUC | 1710 |
| AD-71754 | A-144049 | GAGAACCUGGAAGACAAGUdTdT | 1083 | A-144050 | ACUUGUCUUCCAGGUUCUCdTdT | 1397 | GAGAACCUGGAAGACAAGU | 1711 |
| AD-71755 | A-144051 | UGUGGUAAACUGGACCCCAdTdT | 1084 | A-144052 | UGGGGUCCAGUUUACCACAdTdT | 1398 | UGUGGUAAACUGGACCCCA | 1712 |
| AD-71756 | A-144053 | CACUUUCGCCAGUGCAACUdTdT | 1085 | A-144054 | AGUUGCACUGGCGAAAGUGdTdT | 1399 | CACUUUCGCCAGUGCAACU | 1713 |
| AD-71757 | A-144055 | ACUUUACUGUUUCAGAAAGdTdT | 1086 | A-144056 | CUUUCUGAAACAGUAAAGUdTdT | 1400 | ACUUUACUGUUUCAGAAAG | 1714 |
| AD-71758 | A-144057 | AAGACCCCCAGCCGAUGUdTdT | 1087 | A-144058 | ACAUCGGCUGGGGGUCUUdTdT | 1401 | AAGACCCCCAGCCGAUGU | 1715 |
| AD-71759 | A-144059 | UCCAGCUCUUCCAAGAGGUdTdT | 1088 | A-144060 | ACCUCUUGGAAGAGCUGGAdTdT | 1402 | UCCAGCUCUUCCAAGAGGU | 1716 |
| AD-71760 | A-144061 | UGCCCAAGGGUCAGUCUGAdTdT | 1089 | A-144062 | UCAGACUGACCCUUGGGCAdTdT | 1403 | UGCCCAAGGGUCAGUCUGA | 1717 |
| AD-71761 | A-144063 | GAGGAGGACAUGGUGGGCAdTdT | 1090 | A-144064 | UGCCCACCAUGUCCUCCUCdTdT | 1404 | GAGGAGGACAUGGUGGGCC | 1718 |
| AD-71762 | A-144065 | GCCGGCCCCUGCCCCACCUdTdT | 1091 | A-144066 | AGGUGGGGCAGGGGCCGGCdTdT | 1405 | GCCGGCCCCUGCCCCACCU | 1719 |
| AD-71763 | A-144067 | CCUGGCAGCGGACAUGCAAdTdT | 1092 | A-144068 | UUGCAUGUCCGCUGCCAGGdTdT | 1406 | CCUGGCAGCGGACAUGCAG | 1720 |
| AD-71764 | A-144069 | AGGCCUCUGGUGAGGCCGUdTdT | 1093 | A-144070 | ACGGCCUCACCAGAGGCCUdTdT | 1407 | AGGCCUCUGGUGAGGCCGU | 1721 |
| AD-71765 | A-144071 | UGUACUGUGACGACAUUCAdTdT | 1094 | A-144072 | UGAAUGUCGUCACAGUACAdTdT | 1408 | UGUACUGUGACGACAUUCC | 1722 |
| AD-71766 | A-144073 | CUCGCUACGAGAAUGAGCUdTdT | 1095 | A-144074 | AGCUCAUUCUCGUAGCGAGdTdT | 1409 | CUCGCUACGAGAAUGAGCU | 1723 |

TABLE 7-continued

XDH Modified Sequences

| Duplex Name | Sense Oligo Name | Sense OligoSeq | SEQ ID NO | Antisense Oligo Name | Antisense OligoSeq | SEQ ID NO | mRNA target sequence | SEQ ID NO |
|---|---|---|---|---|---|---|---|---|
| AD-71767 | A-144075 | CUGUCUCUCCGGCUGGUCAdTdT | 1096 | A-144076 | UGACCAGCCGGAGAGACAGdTdT | 1410 | CUGUCUCUCCGGCUGGUCA | 1724 |
| AD-71768 | A-144079 | CCACGCCAAGAUCAAGUCAdTdT | 1097 | A-144080 | UGACUUGAUCUUGGCGUGGdTdT | 1411 | CCACGCCAAGAUCAAGUCC | 1725 |
| AD-71769 | A-144081 | CAUAGAUACAUCAGAAGCUdTdT | 1098 | A-144082 | AGCUUCUGAUGUAUCUAUGdTdT | 1412 | CAUAGAUACAUCAGAAGCU | 1726 |
| AD-71770 | A-144085 | UUUGUUUGUUUCAUUUCCAdTdT | 1099 | A-144086 | UGGAAAUGAAACAAACAAAdTdT | 1413 | UUUGUUUGUUUCAUUUCCG | 1727 |
| AD-71771 | A-144087 | GCUGAUGAUGUUCCUGGGAdTdT | 1100 | A-144088 | UCCCAGGAACAUCAUCAGCdTdT | 1414 | GCUGAUGAUGUUCCUGGGA | 1728 |
| AD-71772 | A-144093 | CAGUCUUUGCGAAGGAUAAdTdT | 1101 | A-144094 | UUAUCCUUCGCAAAGACUGdTdT | 1415 | CAGUCUUUGCGAAGGAUAA | 1729 |
| AD-71773 | A-144095 | AAGGUUACUUGUGUUGGGAdTdT | 1102 | A-144096 | UCCCAACACAAGUAACCUUdTdT | 1416 | AAGGUUACUUGUGUUGGGC | 1730 |
| AD-71774 | A-144097 | CAUAUCAUUGGUGCUGUGAdTdT | 1103 | A-144098 | UCACAGCACCAAUGAUAUGdTdT | 1417 | CAUAUCAUUGGUGCUGUGG | 1731 |
| AD-71775 | A-144099 | UGGUUGCUGACACCCCGGAdTdT | 1104 | A-144100 | UCCGGGGUGUCAGCAACCAdTdT | 1418 | UGGUUGCUGACACCCCGGA | 1732 |
| AD-71776 | A-144101 | ACACACACAGAGAGCUGCAdTdT | 1105 | A-144102 | UGCAGCUCUCUGUGUGUGUdTdT | 1419 | ACACACACAGAGAGCUGCC | 1733 |
| AD-71777 | A-144103 | GCCCAAGGGGUGAAAAUCAdTdT | 1106 | A-144104 | UGAUUUUCACCCCUUGGGCdTdT | 1420 | GCCCAAGGGGUGAAAAUCA | 1734 |
| AD-71778 | A-144105 | UCACCUAUGAAGAACUACAdTdT | 1107 | A-144106 | UGUAGUUCUUCAUAGGUGAdTdT | 1421 | UCACCUAUGAAGAACUACC | 1735 |
| AD-71779 | A-144109 | GAGGAUGCUAUAAAGAACAdTdT | 1108 | A-144110 | UGUUCUUUAUAGCAUCCUCdTdT | 1422 | GAGGAUGCUAUAAAGAACA | 1736 |
| AD-71780 | A-144111 | CAACUCCUUUUAUGGACCUdTdT | 1109 | A-144112 | AGGUCCAUAAAAGGAGUUGdTdT | 1423 | CAACUCCUUUUAUGGACCU | 1737 |
| AD-71781 | A-144113 | CCUGAGCUGAAGAUCGAGAdTdT | 1110 | A-144114 | UCUCGAUCUUCAGCUCAGGdTdT | 1424 | CCUGAGCUGAAGAUCGAGA | 1738 |
| AD-71782 | A-144115 | AAAGGGGACCUAAAGAAGAdTdT | 1111 | A-144116 | UCUUCUUUAGGUCCCCUUUdTdT | 1425 | AAAGGGGACCUAAAGAAGG | 1739 |
| AD-71783 | A-144117 | AGGGGUUUUCCGAAGCAGAdTdT | 1112 | A-144118 | UCUGCUUCGGAAAACCCUdTdT | 1426 | AGGGGUUUUCCGAAGCAGA | 1740 |
| AD-71784 | A-144119 | UAAUGUUGUGUCAGGGGAAdTdT | 1113 | A-144120 | UUCCCCUGACACAACAUUAdTdT | 1427 | UAAUGUUGUGUCAGGGGAG | 1741 |
| AD-71785 | A-144121 | AGAUAUACAUCGGUGGCCAdTdT | 1114 | A-144122 | UGGCCACCGAUGUAUAUCUdTdT | 1428 | AGAUAUACAUCGGUGGCCA | 1742 |
| AD-71786 | A-144123 | GCCAAGAGCACUUCUACCUdTdT | 1115 | A-144124 | AGGUAGAAGUGCUCUUGGCdTdT | 1429 | GCCAAGAGCACUUCUACCU | 1743 |
| AD-71787 | A-144125 | GGAGACUCACUGCACCAUUdTdT | 1116 | A-144126 | AAUGGUGCAGUGAGUCUCCdTdT | 1430 | GGAGACUCACUGCACCAUU | 1744 |
| AD-71788 | A-144127 | UUGCUGUUCCAAAAGGCGAdTdT | 1117 | A-144128 | UCGCCUUUUGGAACAGCAAdTdT | 1431 | UUGCUGUUCCAAAAGGCGA | 1745 |
| AD-71789 | A-144129 | CGAGGCAGGGGAGAUGGAAdTdT | 1118 | A-144130 | UUCCAUCUCCCCUGCCUCGdTdT | 1432 | CGAGGCAGGGGAGAUGGAG | 1746 |
| AD-71790 | A-144131 | AGCUCUUUGUGUCUACACAdTdT | 1119 | A-144132 | UGUGUAGACACAAAGAGCUdTdT | 1433 | AGCUCUUUGUGUCUACACA | 1747 |

TABLE 7-continued

XDH Modified Sequences

| Duplex Name | Sense Oligo Name | Sense OligoSeq | SEQ ID NO | Anti-sense Oligo Name | Antisense OligoSeq | SEQ ID NO | mRNA target sequence | SEQ ID NO |
|---|---|---|---|---|---|---|---|---|
| AD-71791 | A-144133 | CAGAACACCAUGAAGACCAdTdT | 1120 | A-144134 | UGGUCUUCAUGGUGUUCUGdTdT | 1434 | CAGAACACCAUGAAGACCC | 1748 |
| AD-71792 | A-144135 | CAGAGCUUUGUUGCAAAAAdTdT | 1121 | A-144136 | UUUUUGCAACAAAGCUCUGdTdT | 1435 | CAGAGCUUUGUUGCAAAAA | 1749 |
| AD-71793 | A-144137 | AAAAUGUUGGGGGUUCCAAdTdT | 1122 | A-144138 | UUGGAACCCCCAACAUUUUdTdT | 1436 | AAAAUGUUGGGGGUUCCAG | 1750 |
| AD-71794 | A-144139 | AGCAAACCGGAUUGUGGUUdTdT | 1123 | A-144140 | AACCACAAUCCGGUUUGCUdTdT | 1437 | AGCAAACCGGAUUGUGGUU | 1751 |
| AD-71795 | A-144141 | UUCGAGUGAAGAGAAUGGAdTdT | 1124 | A-144142 | UCCAUUCUCUUCACUCGAAdTdT | 1438 | UUCGAGUGAAGAGAAUGGG | 1752 |
| AD-71796 | A-144143 | AGGAGGCUUUGGAGGCAAAdTdT | 1125 | A-144144 | UUUGCCUCCAAAGCCUCCUdTdT | 1439 | AGGAGGCUUUGGAGGCAAG | 1753 |
| AD-71797 | A-144145 | AAGGAGACCCGGAGCACUAdTdT | 1126 | A-144146 | UAGUGCUCCGGGUCUCCUUdTdT | 1440 | AAGGAGACCCGGAGCACUG | 1754 |
| AD-71798 | A-144147 | UGUGGUGUCCACGGCAGUAdTdT | 1127 | A-144148 | UACUGCCGUGGACACCACAdTdT | 1441 | UGUGGUGUCCACGGCAGUG | 1755 |
| AD-71799 | A-144149 | UGGCCCUGGCUGCAUAUAAdTdT | 1128 | A-144150 | UUAUAUGCAGCCAGGGCCAdTdT | 1442 | UGGCCCUGGCUGCAUAUAA | 1756 |
| AD-71800 | A-144153 | UGCGAUGCAUGCUGGACCAdTdT | 1129 | A-144154 | UGGUCCAGCAUGCAUCGCAdTdT | 1443 | UGCGAUGCAUGCUGGACCG | 1757 |
| AD-71801 | A-144155 | CGUGAUGAGGACAUGCUGAdTdT | 1130 | A-144156 | UCAGCAUGUCCUCAUCACGdTdT | 1444 | CGUGAUGAGGACAUGCUGA | 1758 |
| AD-71802 | A-144157 | UAACUGGUGGCAGACAUCAdTdT | 1131 | A-144158 | UGAUGUCUGCCACCAGUUAdTdT | 1445 | UAACUGGUGGCAGACAUCC | 1759 |
| AD-71803 | A-144159 | UCCCUUCCUGGCCAGAUAAdTdT | 1132 | A-144160 | UUAUCUGGCCAGGAAGGGAdTdT | 1446 | UCCCUUCCUGGCCAGAUAC | 1760 |
| AD-71804 | A-144161 | UACAAGGUUGGCUUCAUGAdTdT | 1133 | A-144162 | UCAUGAAGCCAACCUUGUAdTdT | 1447 | UACAAGGUUGGCUUCAUGA | 1761 |
| AD-71805 | A-144163 | AGACUGGGACAGUUGUGGAdTdT | 1134 | A-144164 | UCCACAACUGUCCCAGUCUdTdT | 1448 | AGACUGGGACAGUUGUGGC | 1762 |
| AD-71806 | A-144165 | GCUCUUGAGGUGGACCACUdTdT | 1135 | A-144166 | AGUGGUCCACCUCAAGAGCdTdT | 1449 | GCUCUUGAGGUGGACCACU | 1763 |
| AD-71807 | A-144167 | ACUUCAGCAAUGUGGGGAAdTdT | 1136 | A-144168 | UUCCCCACAUUGCUGAAGUdTdT | 1450 | ACUUCAGCAAUGUGGGGAA | 1764 |
| AD-71808 | A-144169 | GAACACCCAGGAUCUCUCUdTdT | 1137 | A-144170 | AGAGAGAUCCUGGGUGUUCdTdT | 1451 | GAACACCCAGGAUCUCUCU | 1765 |
| AD-71809 | A-144171 | CAGAGUAUUAUGGAACGAAdTdT | 1138 | A-144172 | UUCGUUCCAUAAUACUCUGdTdT | 1452 | CAGAGUAUUAUGGAACGAG | 1766 |
| AD-71810 | A-144173 | AGCUUUAUUCCACAUGGAAdTdT | 1139 | A-144174 | UUCCAUGUGGAAUAAAGCUdTdT | 1453 | AGCUUUAUUCCACAUGGAC | 1767 |
| AD-71811 | A-144175 | ACAACUGCUAUAAAAUCCAdTdT | 1140 | A-144176 | UGGAUUUUAUAGCAGUUGUdTdT | 1454 | ACAACUGCUAUAAAAUCCC | 1768 |
| AD-71812 | A-144177 | UCCCCAACAUCCGGGGCAAdTdT | 1141 | A-144178 | UUGCCCCGGAUGUUGGGGAdTdT | 1455 | UCCCCAACAUCCGGGGCAC | 1769 |
| AD-71813 | A-144179 | UGGGCGGCUGUGCAAAACAdTdT | 1142 | A-144180 | UGUUUUGCACAGCCGCCCAdTdT | 1456 | UGGGCGGCUGUGCAAAACC | 1770 |
| AD-71814 | A-144181 | AACCAACCUUCCCUCCAAdTdT | 1143 | A-144182 | UUUGGAGGGAAGGUUGGUUdTdT | 1457 | AACCAACCUUCCCUCCAAC | 1771 |

TABLE 7-continued

XDH Modified Sequences

| Duplex Name | Sense Oligo Name | Sense OligoSeq | SEQ ID NO | Antisense Oligo Name | Antisense OligoSeq | SEQ ID NO | mRNA target sequence | SEQ ID NO |
|---|---|---|---|---|---|---|---|---|
| AD-71815 | A-144183 | ACACGGCCUUCCGGGGCUUdTdT | 1144 | A-144184 | AAGCCCCGGAAGGCCGUGUdTdT | 1458 | ACACGGCCUUCCGGGGCUU | 1772 |
| AD-71816 | A-144185 | UUGGGGGGCCCCAGGGGAUdTdT | 1145 | A-144186 | AUCCCCUGGGGCCCCCCAAdTdT | 1459 | UUGGGGGGCCCCAGGGGAU | 1773 |
| AD-71817 | A-144187 | AUGCUCAUUGCCGAGUGCUdTdT | 1146 | A-144188 | AGCACUCGGCAAUGAGCAUdTdT | 1460 | AUGCUCAUUGCCGAGUGCU | 1774 |
| AD-71818 | A-144189 | UGGAUGAGUGAAGUUGCAAdTdT | 1147 | A-144190 | UUGCAACUUCACUCAUCCAdTdT | 1461 | UGGAUGAGUGAAGUUGCAG | 1775 |
| AD-71819 | A-144191 | AGUGACCUGUGGGAUGCCUdTdT | 1148 | A-144192 | AGGCAUCCCACAGGUCACUdTdT | 1462 | AGUGACCUGUGGGAUGCCU | 1776 |
| AD-71820 | A-144193 | CCUGCAGAGGAGGUGCGGAdTdT | 1149 | A-144194 | UCCGCACCUCCUCUGCAGGdTdT | 1463 | CCUGCAGAGGAGGUGCGGA | 1777 |
| AD-71821 | A-144195 | AGAAAAAACCUGUACAAAGdTdT | 1150 | A-144196 | CUUUGUACAGGUUUUUUCUdTdT | 1464 | AGAAAAAACCUGUACAAAG | 1778 |
| AD-71822 | A-144197 | AAAGAAGGGGACCUGACACdTdT | 1151 | A-144198 | UGUCAGGUCCCCUUCUUUdTdT | 1465 | AAAGAAGGGGACCUGACAC | 1779 |
| AD-71823 | A-144199 | ACACUUCAACCAGAAGCUUdTdT | 1152 | A-144200 | AAGCUUCUGGUUGAAGUGUdTdT | 1466 | ACACUUCAACCAGAAGCUU | 1780 |
| AD-71824 | A-144201 | UUGAGGGUUUCACCUUGCCdTdT | 1153 | A-144202 | UGCAAGGUGAAACCCUCAAdTdT | 1467 | UUGAGGGUUUCACCUUGCC | 1781 |
| AD-71825 | A-144203 | CAGAUGCUGGGAAGAAUGAdTdT | 1154 | A-144204 | UCAUUCUUCCCAGCAUCUGdTdT | 1468 | CAGAUGCUGGGAAGAAUGC | 1782 |
| AD-71826 | A-144205 | UGCCUAGCAAGCUCUCAGUdTdT | 1155 | A-144206 | ACUGAGAGCUUGCUAGGCAdTdT | 1469 | UGCCUAGCAAGCUCUCAGU | 1783 |
| AD-71827 | A-144207 | UAUCAUGCUCGGAAGAGUAdTdT | 1156 | A-144208 | UACUCUUCCGAGCAUGAUAdTdT | 1470 | UAUCAUGCUCGGAAGAGUG | 1784 |
| AD-71828 | A-144209 | AGUGAGGUUGACAAGUUCAdTdT | 1157 | A-144210 | UGAACUUGUCAACCUCACUdTdT | 1471 | AGUGAGGUUGACAAGUUCA | 1785 |
| AD-71829 | A-144211 | AACAAGGAGAAUUGUUGGAdTdT | 1158 | A-144212 | UCCAACAAUUCUCCUUGUUdTdT | 1472 | AACAAGGAGAAUUGUUGGA | 1786 |
| AD-71830 | A-144213 | AAAAAGAGAGGAUUGUGCAdTdT | 1159 | A-144214 | UGCACAAUCCUCUCUUUUUdTdT | 1473 | AAAAAGAGAGGAUUGUGCA | 1787 |
| AD-71831 | A-144215 | CAUAAUUCCCACCAAGUUUdTdT | 1160 | A-144216 | AAACUUGGUGGGAAUUAUGdTdT | 1474 | CAUAAUUCCCACCAAGUUU | 1788 |
| AD-71832 | A-144217 | UUUGGAAUAAGCUUUACAAdTdT | 1161 | A-144218 | UUGUAAAGCUUAUUCCAAAdTdT | 1475 | UUUGGAAUAAGCUUUACAG | 1789 |
| AD-71833 | A-144219 | AGUUCCUUUUCUGAAUCAAdTdT | 1162 | A-144220 | UUGAUUCAGAAAAGGAACUdTdT | 1476 | AGUUCCUUUUCUGAAUCAG | 1790 |
| AD-71834 | A-144221 | AGGCAGGAGCCCUACUUCAdTdT | 1163 | A-144222 | UGAAGUAGGGCUCCUGCCUdTdT | 1477 | AGGCAGGAGCCCUACUUCA | 1791 |
| AD-71835 | A-144223 | CAUGUGUACACAGAUGGCUdTdT | 1164 | A-144224 | AGCCAUCUGUGUACACAUGdTdT | 1478 | CAUGUGUACACAGAUGGCU | 1792 |
| AD-71836 | A-144225 | UCUGUGCUGCUGACCCACAdTdT | 1165 | A-144226 | UGUGGGUCAGCAGCACAGAdTdT | 1479 | UCUGUGCUGCUGACCCACG | 1793 |
| AD-71837 | A-144229 | GGCCAAGGCCUUCAUACCAdTdT | 1166 | A-144230 | UGGUAUGAAGGCCUUGGCCdTdT | 1480 | GGCCAAGGCCUUCAUACCA | 1794 |
| AD-71838 | A-144231 | AAAAUGGUCCAGGUGGCCAdTdT | 1167 | A-144232 | UGGCCACCUGGACCAUUUUdTdT | 1481 | AAAAUGGUCCAGGUGGCCA | 1795 |

TABLE 7-continued

XDH Modified Sequences

| Duplex Name | Sense Oligo Name | Sense OligoSeq | SEQ ID NO | Antisense Oligo Name | Antisense OligoSeq | SEQ ID NO | mRNA target sequence | SEQ ID NO |
|---|---|---|---|---|---|---|---|---|
| AD-71839 | A-144233 | GCCAGUAGAGCUCUGAAAAdTdT | 1168 | A-144234 | UUUUCAGAGCUCUACUGGCdTdT | 1482 | GCCAGUAGAGCUCUGAAAA | 1796 |
| AD-71840 | A-144235 | AAUCCCCACCUCUAAGAUUdTdT | 1169 | A-144236 | AAUCUUAGAGGUGGGGAUUdTdT | 1483 | AAUCCCCACCUCUAAGAUU | 1797 |
| AD-71841 | A-144237 | UAUAUCAGCGAGACAAGCAdTdT | 1170 | A-144238 | UGCUUGUCUCGCUGAUAUAdTdT | 1484 | UAUAUCAGCGAGACAAGCA | 1798 |
| AD-71842 | A-144239 | AGCACUAACACUGUGCCCAdTdT | 1171 | A-144240 | UGGGCACAGUGUUAGUGCUdTdT | 1485 | AGCACUAACACUGUGCCCA | 1799 |
| AD-71843 | A-144241 | CAACACCUCUCCCACGGCUdTdT | 1172 | A-144242 | AGCCGUGGGAGAGGUGUUGdTdT | 1486 | CAACACCUCUCCCACGGCU | 1800 |
| AD-71844 | A-144243 | UGCCUCUGUCAGCGCUGAAdTdT | 1173 | A-144244 | UUCAGCGCUGACAGAGGCAdTdT | 1487 | UGCCUCUGUCAGCGCUGAC | 1801 |
| AD-71845 | A-144245 | ACCUCAAUGGACAGGCCGUdTdT | 1174 | A-144246 | ACGGCCUGUCCAUUGAGGUdTdT | 1488 | ACCUCAAUGGACAGGCCGU | 1802 |
| AD-71846 | A-144247 | GUCUAUGCGGCUUGUCAGAdTdT | 1175 | A-144248 | UCUGACAAGCCGCAUAGACdTdT | 1489 | GUCUAUGCGGCUUGUCAGA | 1803 |
| AD-71847 | A-144249 | AGACCAUCUUGAAAAGGCUdTdT | 1176 | A-144250 | AGCCUUUUCAAGAUGGUCUdTdT | 1490 | AGACCAUCUUGAAAAGGCU | 1804 |
| AD-71848 | A-144251 | UGGAACCCUACAAGAAGAAdTdT | 1177 | A-144252 | UUCUUCUUGUAGGGUUCCAdTdT | 1491 | UGGAACCCUACAAGAAGAA | 1805 |
| AD-71849 | A-144253 | AAGAAUCCCAGUGGCUCCUdTdT | 1178 | A-144254 | AGGAGCCACUGGGAUUCUUdTdT | 1492 | AAGAAUCCCAGUGGCUCCU | 1806 |
| AD-71850 | A-144255 | UGGGAAGACUGGGUCACAAdTdT | 1179 | A-144256 | UUGUGACCCAGUCUUCCCAdTdT | 1493 | UGGGAAGACUGGGUCACAG | 1807 |
| AD-71851 | A-144257 | ACAGCUGCCUACAUGGACAdTdT | 1180 | A-144258 | UGUCCAUGUAGGCAGCUGUdTdT | 1494 | ACAGCUGCCUACAUGGACA | 1808 |
| AD-71852 | A-144259 | ACAGUGAGCUUGUCUGCCAdTdT | 1181 | A-144260 | UGGCAGACAAGCUCACUGUdTdT | 1495 | ACAGUGAGCUUGUCUGCCA | 1809 |
| AD-71853 | A-144261 | ACUGGGUUUUAUAGAACAAdTdT | 1182 | A-144262 | UUGUUCUAUAAAACCCAGUdTdT | 1496 | ACUGGGUUUUAUAGAACAC | 1810 |
| AD-71854 | A-144263 | ACCCAAUCUGGGCUACAGAdTdT | 1183 | A-144264 | UCUGUAGCCCAGAUUGGGUdTdT | 1497 | ACCCAAUCUGGGCUACAGC | 1811 |
| AD-71855 | A-144265 | CAGCUUUGAGACUAACUCAdTdT | 1184 | A-144266 | UGAGUUAGUCUCAAAGCUGdTdT | 1498 | CAGCUUUGAGACUAACUCA | 1812 |
| AD-71856 | A-144267 | GGGAACCCCUUCCACUACUdTdT | 1185 | A-144268 | AGUAGUGGAAGGGGUUCCCdTdT | 1499 | GGGAACCCCUUCCACUACU | 1813 |
| AD-71857 | A-144269 | CUUCAGCUAUGGGGUGGCUdTdT | 1186 | A-144270 | AGCCACCCCAUAGCUGAAGdTdT | 1500 | CUUCAGCUAUGGGGUGGCU | 1814 |
| AD-71858 | A-144271 | CUUGCUCUGAAGUAGAAAUdTdT | 1187 | A-144272 | AUUUCUACUUCAGAGCAAGdTdT | 1501 | CUUGCUCUGAAGUAGAAAU | 1815 |
| AD-71859 | A-144273 | AAAUCGACUGCCUAACAGAdTdT | 1188 | A-144274 | UCUGUUAGGCAGUCGAUUUdTdT | 1502 | AAAUCGACUGCCUAACAGG | 1816 |
| AD-71860 | A-144275 | GAGAUCAUAAGAACCUCCAdTdT | 1189 | A-144276 | UGGAGGUUCUUAUGAUCUCdTdT | 1503 | GAGAUCAUAAGAACCUCCG | 1817 |
| AD-71861 | A-144277 | GCACAGAUAUUGUCAUGGAdTdT | 1190 | A-144278 | UCCAUGACAAUAUCUGUGCdTdT | 1504 | GCACAGAUAUUGUCAUGGA | 1818 |
| AD-71862 | A-144279 | UGGAUGUUGGCUCCAGUCUdTdT | 1191 | A-144280 | AGACUGGAGCCAACAUCCAdTdT | 1505 | UGGAUGUUGGCUCCAGUCU | 1819 |

TABLE 7-continued

XDH Modified Sequences

| Duplex Name | Sense Oligo Name | Sense OligoSeq | SEQ ID NO | Antisense Oligo Name | Antisense OligoSeq | SEQ ID NO | mRNA target sequence | SEQ ID NO |
|---|---|---|---|---|---|---|---|---|
| AD-71863 | A-144281 | UAAACCCUGCCAUUGAUAUdTdT | 1192 | A-144282 | AUAUCAAUGGCAGGGUUUAdTdT | 1506 | UAAACCCUGCCAUUGAUAU | 1820 |
| AD-71864 | A-144283 | UUGGACAGGUGGAAGGGGAdTdT | 1193 | A-144284 | UCCCCUUCCACCUGUCCAAdTdT | 1507 | UUGGACAGGUGGAAGGGGC | 1821 |
| AD-71865 | A-144285 | GGGCAUUUGUCCAGGGCCUdTdT | 1194 | A-144286 | AGGCCCUGGACAAAUGCCCdTdT | 1508 | GGGCAUUUGUCCAGGGCCU | 1822 |
| AD-71866 | A-144287 | UUGGCCUCUUCACCCUAGAdTdT | 1195 | A-144288 | UCUAGGGUGAAGAGGCCAAdTdT | 1509 | UUGGCCUCUUCACCCUAGA | 1823 |
| AD-71867 | A-144289 | AGAGGAGCUACACUAUUCAdTdT | 1196 | A-144290 | UGAAUAGUGUAGCUCCUCUdTdT | 1510 | AGAGGAGCUACACUAUUCC | 1824 |
| AD-71868 | A-144291 | CCCCGAGGGGAGCCUGCAAdTdT | 1197 | A-144292 | UUGCAGGCUCCCCUCGGGGdTdT | 1511 | CCCCGAGGGGAGCCUGCAC | 1825 |
| AD-71869 | A-144293 | CACACCCGUGGCCCUAGCAdTdT | 1198 | A-144294 | UGCUAGGGCCACGGGUGUGdTdT | 1512 | CACACCCGUGGCCCUAGCA | 1826 |
| AD-71870 | A-144295 | ACCUACAAGAUCCCGGCAUdTdT | 1199 | A-144296 | AUGCCGGGAUCUUGUAGGUdTdT | 1513 | ACCUACAAGAUCCCGGCAU | 1827 |
| AD-71871 | A-144297 | UUUGGCAGCAUCCCCAUUAdTdT | 1200 | A-144298 | UAAUGGGGAUGCUGCCAAAdTdT | 1514 | UUUGGCAGCAUCCCCAUUG | 1828 |
| AD-71872 | A-144301 | CCUGCUCCGCGACUGCCCAdTdT | 1201 | A-144302 | UGGGCAGUCGCGGAGCAGGdTdT | 1515 | CCUGCUCCGCGACUGCCCC | 1829 |
| AD-71873 | A-144303 | CAACAAGAAGGCCAUCUAUdTdT | 1202 | A-144304 | AUAGAUGGCCUUCUUGUUGdTdT | 1516 | CAACAAGAAGGCCAUCUAU | 1830 |
| AD-71874 | A-144305 | UAUGCAUCGAAGGCUGUUAdTdT | 1203 | A-144306 | UAACAGCCUUCGAUGCAUAdTdT | 1517 | UAUGCAUCGAAGGCUGUUG | 1831 |
| AD-71875 | A-144307 | UGGAGAGCCGCCCCUCUUAdTdT | 1204 | A-144308 | UAAGAGGGGCGGCUCUCCAdTdT | 1518 | UGGAGAGCCGCCCCUCUUC | 1832 |
| AD-71876 | A-144309 | UCCUGGCUGCUUCUAUCUUdTdT | 1205 | A-144310 | AAGAUAGAAGCAGCCAGGAdTdT | 1519 | UCCUGGCUGCUUCUAUCUU | 1833 |
| AD-71877 | A-144311 | UUCUUUGCCAUCAAAGAUAdTdT | 1206 | A-144312 | UAUCUUUGAUGGCAAAGAAdTdT | 1520 | UUCUUUGCCAUCAAAGAUG | 1834 |
| AD-71878 | A-144313 | CCAUCCGUGCAGCUCGAGAdTdT | 1207 | A-144314 | UCUCGAGCUGCACGGAUGGdTdT | 1521 | CCAUCCGUGCAGCUCGAGC | 1835 |
| AD-71879 | A-144315 | AGCUCAGCACACAGGUAAUdTdT | 1208 | A-144316 | AUUACCUGUGUGCUGAGCUdTdT | 1522 | AGCUCAGCACACAGGUAAU | 1836 |
| AD-71880 | A-144317 | AAUAACGUGAAGGAACUCUdTdT | 1209 | A-144318 | AGAGUUCCUUCACGUUAUUdTdT | 1523 | AAUAACGUGAAGGAACUCU | 1837 |
| AD-71881 | A-144319 | UUCCGGCUAGACAGCCCUAdTdT | 1210 | A-144320 | UAGGGCUGUCUAGCCGGAAdTdT | 1524 | UUCCGGCUAGACAGCCCUG | 1838 |
| AD-71882 | A-144321 | UGCCACCCCGGAGAAGAUAdTdT | 1211 | A-144322 | UAUCUUCUCCGGGGUGGCAdTdT | 1525 | UGCCACCCCGGAGAAGAUC | 1839 |
| AD-71883 | A-144323 | AUCCGCAAUGCCUGCGUGAdTdT | 1212 | A-144324 | UCACGCAGGCAUUGCGGAUdTdT | 1526 | AUCCGCAAUGCCUGCGUGG | 1840 |
| AD-71884 | A-144325 | GACAAGUUCACCACCCUGUdTdT | 1213 | A-144326 | ACAGGGUGGUGAACUUGUCdTdT | 1527 | GACAAGUUCACCACCCUGU | 1841 |
| AD-71885 | A-144327 | UGUGUGUCACUGGUGUCCAdTdT | 1214 | A-144328 | UGGACACCAGUGACACACAdTdT | 1528 | UGUGUGUCACUGGUGUCCC | 1842 |
| AD-71886 | A-144329 | AGAAAACUGCAAACCCUGAdTdT | 1215 | A-144330 | UCAGGGUUUGCAGUUUUCUdTdT | 1529 | AGAAAACUGCAAACCCUGG | 1843 |

TABLE 7-continued

XDH Modified Sequences

| Duplex Name | Sense Oligo Name | Sense OligoSeq | SEQ ID NO | Antisense Oligo Name | Antisense OligoSeq | SEQ ID NO | mRNA target sequence | SEQ ID NO |
|---|---|---|---|---|---|---|---|---|
| AD-71887 | A-144331 | CUGGUCUGUGAGGGUCUAAdTdT | 1216 | A-144332 | UUAGACCCUCACAGACCAGdTdT | 1530 | CUGGUCUGUGAGGGUCUAA | 1844 |
| AD-71888 | A-144333 | AAAGAGAGAGUCCUCAGCAdTdT | 1217 | A-144334 | UGCUGAGGACUCUCUCUUUdTdT | 1531 | AAAGAGAGAGUCCUCAGCA | 1845 |
| AD-71889 | A-144335 | AGAGUCUUCUUGUGCUGCCdTdT | 1218 | A-144336 | UGCAGCACAAGAAGACUCUdTdT | 1532 | AGAGUCUUCUUGUGCUGCC | 1846 |
| AD-71890 | A-144337 | GCCUUUGGGCUUCCAUGGAdTdT | 1219 | A-144338 | UCCAUGGAAGCCCAAAGGCdTdT | 1533 | GCCUUUGGGCUUCCAUGGA | 1847 |
| AD-71891 | A-144341 | CAGAACAUGGAUCUAUUAAdTdT | 1220 | A-144342 | UUAAUAGAUCCAUGUUCUGdTdT | 1534 | CAGAACAUGGAUCUAUUAA | 1848 |
| AD-71892 | A-144343 | UUAAAGUCACAGAAUGACAdTdT | 1221 | A-144344 | UGUCAUUCUGUGACUUUAAdTdT | 1535 | UUAAAGUCACAGAAUGACA | 1849 |
| AD-71893 | A-144345 | AGACCUGUGAUUUGUCAAdTdT | 1222 | A-144346 | UUUGACAAAUCACAGGUCUdTdT | 1536 | AGACCUGUGAUUUGUCAAG | 1850 |
| AD-71894 | A-144347 | AGAUGGGAUUUGGAAGACAdTdT | 1223 | A-144348 | UGUCUUCCAAAUCCCAUCUdTdT | 1537 | AGAUGGGAUUUGGAAGACA | 1851 |
| AD-71895 | A-144349 | AAGUGAAUGCAAUGGAAGAdTdT | 1224 | A-144350 | UCUUCCAUUGCAUUCACUUdTdT | 1538 | AAGUGAAUGCAAUGGAAGA | 1852 |
| AD-71896 | A-144351 | AAGAUUUGAUCAAAAAUAdTdT | 1225 | A-144352 | UAUUUUGAUCAAAAUCUdTdT | 1539 | AAGAUUUGAUCAAAAAUG | 1853 |
| AD-71897 | A-144353 | UGUAAUUUGUAAACACAAUdTdT | 1226 | A-144354 | AUUGUGUUUACAAAUUACAdTdT | 1540 | UGUAAUUUGUAAACACAAU | 1854 |
| AD-71898 | A-144355 | GAUAAGCAAAUUCAAAACUdTdT | 1227 | A-144356 | AGUUUUGAAUUUGCUUAUCdTdT | 1541 | GAUAAGCAAAUUCAAAACU | 1855 |
| AD-71899 | A-144357 | ACUGUUAUGCCUAAAUGGUdTdT | 1228 | A-144358 | ACCAUUUAGGCAUAACAGUdTdT | 1542 | ACUGUUAUGCCUAAAUGGU | 1856 |
| AD-71900 | A-144359 | UGAAUAUGCAAUUAGGAUAdTdT | 1229 | A-144360 | UAUCCUAAUUGCAUAUUCAdTdT | 1543 | UGAAUAUGCAAUUAGGAUC | 1857 |
| AD-71901 | A-144361 | AUCAUUUCUGUCUGUUUUdTdT | 1230 | A-144362 | AAAACAGACAGAAAUGAUdTdT | 1544 | AUCAUUUCUGUCUGUUUU | 1858 |
| AD-71902 | A-144363 | UUAAUCAUGUAUCUGGAAUdTdT | 1231 | A-144364 | AUUCCAGAUACAUGAUUAAdTdT | 1545 | UUAAUCAUGUAUCUGGAAU | 1859 |
| AD-71903 | A-144365 | AAUAGGGUCGGGAAGGGUUdTdT | 1232 | A-144366 | AACCCUUCCCGACCCUAUUdTdT | 1546 | AAUAGGGUCGGGAAGGGUU | 1860 |
| AD-71904 | A-144367 | UUUGUGCUAUUCCCCACUUdTdT | 1233 | A-144368 | AAGUGGGGAAUAGCACAAAdTdT | 1547 | UUUGUGCUAUUCCCCACUU | 1861 |
| AD-71905 | A-144369 | UUACUGGACAGCCUGUAUAdTdT | 1234 | A-144370 | UAUACAGGCUGUCCAGUAAdTdT | 1548 | UUACUGGACAGCCUGUAUA | 1862 |
| AD-71906 | A-144371 | AACCUCAAGUUCUGAUGGUdTdT | 1235 | A-144372 | ACCAUCAGAACUUGAGGUUdTdT | 1549 | AACCUCAAGUUCUGAUGGU | 1863 |
| AD-71907 | A-144373 | UGUCUGUCCUUUGAAGAGAdTdT | 1236 | A-144374 | UCUCUUCAAAGGACAGACAdTdT | 1550 | UGUCUGUCCUUUGAAGAGG | 1864 |
| AD-71908 | A-144375 | AGGAUUCCCACAAACCUCUdTdT | 1237 | A-144376 | AGAGGUUUGUGGGAAUCCUdTdT | 1551 | AGGAUUCCCACAAACCUCU | 1865 |
| AD-71909 | A-144377 | UAGAAGCUUAAACCGAAGUdTdT | 1238 | A-144378 | ACUUCGGUUUAAGCUUCUAdTdT | 1552 | UAGAAGCUUAAACCGAAGU | 1866 |
| AD-71910 | A-144379 | AAGUUACUUUAAAUCGUGUdTdT | 1239 | A-144380 | ACACGAUUUAAAGUAACUUdTdT | 1553 | AAGUUACUUUAAAUCGUGU | 1867 |

TABLE 7-continued

XDH Modified Sequences

| Duplex Name | Sense Oligo Name | Sense OligoSeq | SEQ ID NO | Antisense Oligo Name | Antisense OligoSeq | SEQ ID NO | mRNA target sequence | SEQ ID NO |
|---|---|---|---|---|---|---|---|---|
| AD-71911 | A-144381 | UGCCUUCCUGUGAAAGCCUdTdT | 1240 | A-144382 | AGGCUUUCACAGGAAGGCAdTdT | 1554 | UGCCUUCCUGUGAAAGCCU | 1868 |
| AD-71912 | A-144383 | CUGGCCUUCAAACCAAUGAdTdT | 1241 | A-144384 | UCAUUGGUUUGAAGGCCAGdTdT | 1555 | CUGGCCUUCAAACCAAUGA | 1869 |
| AD-71913 | A-144385 | AACAGCAAAGCAUAACCUUdTdT | 1242 | A-144386 | AAGGUUAUGCUUUGCUGUUdTdT | 1556 | AACAGCAAAGCAUAACCUU | 1870 |
| AD-71914 | A-144387 | UUGAAUCUAUACUCAAAUUdTdT | 1243 | A-144388 | AAUUUGAGUAUAGAUUCAAdTdT | 1557 | UUGAAUCUAUACUCAAAUU | 1871 |
| AD-71915 | A-144389 | UUUUGCAAUGAGGCAGUGAdTdT | 1244 | A-144390 | UCACUGCCUCAUUGCAAAAdTdT | 1558 | UUUUGCAAUGAGGCAGUGG | 1872 |
| AD-71916 | A-144391 | UGGGGUAAGGUUAAAUCCUdTdT | 1245 | A-144392 | AGGAUUUAACCUUACCCCAdTdT | 1559 | UGGGGUAAGGUUAAAUCCU | 1873 |
| AD-71917 | A-144393 | UCUAACCAUCUUUGAAUCAdTdT | 1246 | A-144394 | UGAUUCAAAGAUGGUUAGAdTdT | 1560 | UCUAACCAUCUUUGAAUCA | 1874 |
| AD-71918 | A-144395 | AUCAUUGGAAAGAAUAAAGdTdT | 1247 | A-144396 | CUUUAUUCUUUCCAAUGAdTdT | 1561 | AUCAUUGGAAAGAAUAAAG | 1875 |
| AD-71919 | A-144397 | AAUGAAACAAAUUCAAGGUdTdT | 1248 | A-144398 | ACCUUGAAUUUGUUUCAUUdTdT | 1562 | AAUGAAACAAAUUCAAGGU | 1876 |
| AD-71920 | A-144399 | AGGUUAAUUGGAUCUGAUUdTdT | 1249 | A-144400 | AAUCAGAUCCAAUUAACCUdTdT | 1563 | AGGUUAAUUGGAUCUGAUU | 1877 |
| AD-71921 | A-144401 | UUUGUGAAGCUGCAUAAAGdTdT | 1250 | A-144402 | CUUUAUGCAGCUUCACAAAdTdT | 1564 | UUUGUGAAGCUGCAUAAAG | 1878 |
| AD-71922 | A-144403 | AGCAAGAUUACUCUAUAAUdTdT | 1251 | A-144404 | AUUAUAGAGUAAUCUUGCUdTdT | 1565 | AGCAAGAUUACUCUAUAAU | 1879 |
| AD-71923 | A-144405 | UACAAAAAUCCAACCAACUdTdT | 1252 | A-144406 | AGUUGGUUGGAUUUUUGUAdTdT | 1566 | UACAAAAAUCCAACCAACU | 1880 |
| AD-71924 | A-144407 | ACUCAAUUAUUGAGCACGUdTdT | 1253 | A-144408 | ACGUGCUCAAUAAUUGAGUdTdT | 1567 | ACUCAAUUAUUGAGCACGU | 1881 |
| AD-71925 | A-144409 | UACAAUGUUCUAGAUUUCUdTdT | 1254 | A-144410 | AGAAAUCUAGAACAUUGUAdTdT | 1568 | UACAAUGUUCUAGAUUUCU | 1882 |
| AD-71926 | A-144411 | UUCUUUCCCUUCCUCUUUAdTdT | 1255 | A-144412 | UAAAGAGGAAGGGAAAGAAdTdT | 1569 | UUCUUUCCCUUCCUCUUUG | 1883 |
| AD-71927 | A-144413 | GAAGAGAAUAUUUGUAUUAdTdT | 1256 | A-144414 | UAAUACAAAUAUUCUCUUCdTdT | 1570 | GAAGAGAAUAUUUGUAUUC | 1884 |
| AD-71928 | A-144415 | UUCCAAAUACUCUUUGAGUdTdT | 1257 | A-144416 | ACUCAAAGAGUAUUUGGAAdTdT | 1571 | UUCCAAAUACUCUUUGAGU | 1885 |
| AD-71929 | A-144417 | UAUUUACAAAAAGAUUAUdTdT | 1258 | A-144418 | AUAAUCUUUUUGUAAAUAdTdT | 1572 | UAUUUACAAAAAGAUUAU | 1886 |
| AD-72020 | A-144419 | UAUGUUUAAUCUUUACAUUdTdT | 1259 | A-144420 | AAUGUAAAGAUUAAACAUdTdT | 1573 | UAUGUUUAAUCUUUACAUU | 1887 |
| AD-72021 | A-144421 | UUUGAAGCCAAAGUAAUUUdTdT | 1260 | A-144422 | AAAUUACUUUGGCUUCAAAdTdT | 1574 | UUUGAAGCCAAAGUAAUUU | 1888 |
| AD-72022 | A-144423 | UUCCACCUAGAAAUGAUGAdTdT | 1261 | A-144424 | UCAUCAUUUCUAGGUGGAAdTdT | 1575 | UUCCACCUAGAAAUGAUGC | 1889 |
| AD-72023 | A-144425 | UAUCAGUCCUGGCAUGGUAdTdT | 1262 | A-144426 | UACCAUGCCAGGACUGAUAdTdT | 1576 | UAUCAGUCCUGGCAUGGUG | 1890 |
| AD-72024 | A-144427 | UGGCUCACCCCUAUAAUCAdTdT | 1263 | A-144428 | UGAUUAUAGGGGUGAGCCAdTdT | 1577 | UGGCUCACCCCUAUAAUCC | 1891 |

TABLE 7-continued

XDH Modified Sequences

| Duplex Name | Sense Oligo Name | Sense OligoSeq | SEQ ID NO | Antisense Oligo Name | Antisense OligoSeq | SEQ ID NO | mRNA target sequence | SEQ ID NO |
| --- | --- | --- | --- | --- | --- | --- | --- | --- |
| AD-72025 | A-144429 | AUCCCAGCACUUUGGGAGAdTdT | 1264 | A-144430 | UCUCCCAAAGUGCUGGGAUdTdT | 1578 | AUCCCAGCACUUUGGGAGG | 1892 |
| AD-72026 | A-144431 | CUAAGGCAGGAGAAUUGCUdTdT | 1265 | A-144432 | AGCAAUUCUCCUGCCUUAGdTdT | 1579 | CUAAGGCAGGAGAAUUGCU | 1893 |
| AD-72027 | A-144433 | UGCUUGAGCCCAGCAGUUUdTdT | 1266 | A-144434 | AAACUGCUGGGCUCAAGCAdTdT | 1580 | UGCUUGAGCCCAGCAGUUU | 1894 |
| AD-72028 | A-144435 | UUGAGACCAGCCUGGGCAAdTdT | 1267 | A-144436 | UUGCCCAGGCUGGUCUCAAdTdT | 1581 | UUGAGACCAGCCUGGGCAA | 1895 |
| AD-72029 | A-144437 | ACAUAGAGAGCUCCUGUCUdTdT | 1268 | A-144438 | AGACAGGAGCUCUCUAUGUdTdT | 1582 | ACAUAGAGAGCUCCUGUCU | 1896 |
| AD-72030 | A-144439 | UCUUUAAAAAAAAUUUUUdTdT | 1269 | A-144440 | AAAAAAUUUUUUUAAAGAdTdT | 1583 | UCUUUAAAAAAAAUUUUUU | 1897 |
| AD-72031 | A-144441 | UUAAUUAGUUGGUCUUGAUdTdT | 1270 | A-144442 | AUCAAGACCAACUAAUUAAdTdT | 1584 | UUAAUUAGUUGGUCUUGAU | 1898 |
| AD-72032 | A-144443 | UAGUGCAUGCCUGUAGUCAdTdT | 1271 | A-144444 | UGACUACAGGCAUGCACUAdTdT | 1585 | UAGUGCAUGCCUGUAGUCC | 1899 |
| AD-72033 | A-144445 | CCCAACUACUUGAAAGGCUdTdT | 1272 | A-144446 | AGCCUUUCAAGUAGUUGGGdTdT | 1586 | CCCAACUACUUGAAAGGCU | 1900 |
| AD-72034 | A-144447 | CUGAGGUGGAGAGAUCAUUdTdT | 1273 | A-144448 | AAUGAUCUCUCCACCUCAGdTdT | 1587 | CUGAGGUGGAGAGAUCAUU | 1901 |
| AD-72035 | A-144449 | UUUGAGCUCAGGAGGUUGAdTdT | 1274 | A-144450 | UCAACCUCCUGAGCUCAAAdTdT | 1588 | UUUGAGCUCAGGAGGUUGA | 1902 |
| AD-72036 | A-144451 | UUGAGGCUGCAGUGAGCUAdTdT | 1275 | A-144452 | UAGCUCACUGCAGCCUCAAdTdT | 1589 | UUGAGGCUGCAGUGAGCUA | 1903 |
| AD-72037 | A-144455 | CUCCUGCCUGAGCGACUGAdTdT | 1276 | A-144456 | UCAGUCGCUCAGGCAGGAGdTdT | 1590 | CUCCUGCCUGAGCGACUGA | 1904 |
| AD-72038 | A-144457 | UGAGCAAGAUCUUGUCUCUdTdT | 1277 | A-144458 | AGAGACAAGAUCUUGCUCAdTdT | 1591 | UGAGCAAGAUCUUGUCUCU | 1905 |
| AD-72039 | A-144459 | UGAAGAAAAAAAAGAAAUdTdT | 1278 | A-144460 | AUUUCUUUUUUUUCUUCAdTdT | 1592 | UGAAGAAAAAAAAAGAAAU | 1906 |
| AD-72040 | A-144461 | UAAAAAUGCUGCUAUCAAAdTdT | 1279 | A-144462 | UUUGAUAGCAGCAUUUUUAdTdT | 1593 | UAAAAAUGCUGCUAUCAAA | 1907 |
| AD-72041 | A-144463 | AAAAUCAAGCCCAACCAGAdTdT | 1280 | A-144464 | UCUGGUUGGGCUUGAUUUUdTdT | 1594 | AAAAUCAAGCCCAACCAGA | 1908 |
| AD-72042 | A-144465 | AGAGGUAGAAGAGCCAAGAdTdT | 1281 | A-144466 | UCUUGGCUCUUCUACCUCUdTdT | 1595 | AGAGGUAGAAGAGCCAAGA | 1909 |
| AD-72043 | A-144467 | AAGCCUGGGUUCUCAUCCUdTdT | 1282 | A-144468 | AGGAUGAGAACCCAGGCUUdTdT | 1596 | AAGCCUGGGUUCUCAUCCU | 1910 |
| AD-72044 | A-144469 | CUAGCUCUGUCUCUUCUGUdTdT | 1283 | A-144470 | ACAGAAGAGACAGAGCUAGdTdT | 1597 | CUAGCUCUGUCUCUUCUGU | 1911 |
| AD-72045 | A-144473 | UUGGACUGUCAAUUCCCCUdTdT | 1284 | A-144474 | AGGGGAAUUGACAGUCCAAdTdT | 1598 | UUGGACUGUCAAUUCCCCU | 1912 |
| AD-72046 | A-144475 | CCUUCCUGUGAUCCAUUUUdTdT | 1285 | A-144476 | AAAAUGGAUCACAGGAAGGdTdT | 1599 | CCUUCCUGUGAUCCAUUUU | 1913 |
| AD-72047 | A-144481 | UCUCACGUCUUCUGCUUUAdTdT | 1286 | A-144482 | UAAAGCAGAAGACGUGAGAdTdT | 1600 | UCUCACGUCUUCUGCUUUA | 1914 |
| AD-72048 | A-144485 | UAUGACCUGAAAACUCCAAdTdT | 1287 | A-144486 | UUGGAGUUUUCAGGUCAUAdTdT | 1601 | UAUGACCUGAAAACUCCAG | 1915 |

TABLE 7-continued

XDH Modified Sequences

| Duplex Name | Sense Oligo Name | Sense OligoSeq | SEQ ID NO | Antisense Oligo Name | Antisense OligoSeq | SEQ ID NO | mRNA target sequence | SEQ ID NO |
|---|---|---|---|---|---|---|---|---|
| AD-72049 | A-144487 | UUACAUAAAGGAUCUGCAAdTdT | 1288 | A-144488 | UUGCAGAUCCUUUAUGUAAdTdT | 1602 | UUACAUAAAGGAUCUGCAG | 1916 |
| AD-72050 | A-144489 | CAGCUAUCUAAGGCUUGGUdTdT | 1289 | A-144490 | ACCAAGCCUUAGAUAGCUGdTdT | 1603 | CAGCUAUCUAAGGCUUGGU | 1917 |
| AD-72051 | A-144493 | AUGAUACCUGGGUCUAAUAdTdT | 1290 | A-144494 | UAUUAGACCCAGGUAUCAUdTdT | 1604 | AUGAUACCUGGGUCUAAUG | 1918 |
| AD-72052 | A-144495 | AACUCUGCUGAGAUCACCUdTdT | 1291 | A-144496 | AGGUGAUCUCAGCAGAGUUdTdT | 1605 | AACUCUGCUGAGAUCACCU | 1919 |
| AD-72053 | A-144497 | ACCUCAAGUUUCUGCGGUUdTdT | 1292 | A-144498 | AACCGCAGAAACUUGAGGUdTdT | 1606 | ACCUCAAGUUUCUGCGGUU | 1920 |
| AD-72054 | A-144499 | UUGGUAAAGAGAACAAGGAdTdT | 1293 | A-144500 | UCCUUGUUCUCUUUACCAAdTdT | 1607 | UUGGUAAAGAGAACAAGGG | 1921 |
| AD-72055 | A-144501 | AAGAACAAACAUCCCUUUUdTdT | 1294 | A-144502 | AAAAGGGAUGUUUGUUCUUdTdT | 1608 | AAGAACAAACAUCCCUUUU | 1922 |
| AD-72056 | A-144503 | UUUUAUUGCUCCAAAUGGUdTdT | 1295 | A-144504 | ACCAUUUGGAGCAAUAAAAdTdT | 1609 | UUUUAUUGCUCCAAAUGGU | 1923 |
| AD-72057 | A-144505 | GAUUUAAUCCCUACAUGGUdTdT | 1296 | A-144506 | ACCAUGUAGGGAUUAAAUCdTdT | 1610 | GAUUUAAUCCCUACAUGGU | 1924 |
| AD-72058 | A-144507 | GGUGCUGGGUGGACAAUGUdTdT | 1297 | A-144508 | ACAUUGUCCACCCAGCACCdTdT | 1611 | GGUGCUGGGUGGACAAUGU | 1925 |
| AD-72059 | A-144509 | UGUCACUGUCACAUGCCUUdTdT | 1298 | A-144510 | AAGGCAUGUGACAGUGACAdTdT | 1612 | UGUCACUGUCACAUGCCUU | 1926 |
| AD-72060 | A-144511 | UUCACUGUAUAAAUCCAAAdTdT | 1299 | A-144512 | UUUGGAUUUAUACAGUGAAdTdT | 1613 | UUCACUGUAUAAAUCCAAC | 1927 |
| AD-72061 | A-144513 | ACCUUCUGCCAGAGAGAAUdTdT | 1300 | A-144514 | AUUCUCUCUGGCAGAAGGUdTdT | 1614 | ACCUUCUGCCAGAGAGAAU | 1928 |
| AD-72062 | A-144517 | CAUGGAGGGAGGAUAGUGAdTdT | 1301 | A-144518 | UCACUAUCCUCCCUCCAUGdTdT | 1615 | CAUGGAGGGAGGAUAGUGG | 1929 |
| AD-72063 | A-144519 | AAAUGAUAUAGUUGGACUAdTdT | 1302 | A-144520 | UAGUCCAACUAUAUCAUUUdTdT | 1616 | AAAUGAUAUAGUUGGACUG | 1930 |
| AD-72064 | A-144521 | ACUGGUGCUUGAUGUCACUdTdT | 1303 | A-144522 | AGUGACAUCAAGCACCAGUdTdT | 1617 | ACUGGUGCUUGAUGUCACU | 1931 |
| AD-72065 | A-144523 | CUAAUAAAUGAAACUGUCAdTdT | 1304 | A-144524 | UGACAGUUUCAUUUAUUAGdTdT | 1618 | CUAAUAAAUGAAACUGUCA | 1932 |

TABLE 8

XDH Single Dose (10 nM) Screen in Primary Human Hepatocytes

| Duplex Name | AVG | STDEV | Position in NM_000379.3 |
|---|---|---|---|
| AD-71930 | 82.8 | 4.5 | 18-36 |
| AD-71931 | 56.8 | 3.9 | 36-54 |
| AD-71932 | 60.4 | 4.8 | 69-87 |
| AD-71933 | 49.5 | 5.4 | 86-104 |
| AD-71934 | 65.8 | 15.1 | 104-122 |
| AD-71935 | 50.8 | 6.2 | 119-137 |
| AD-71936 | 65.3 | 19.6 | 154-172 |
| AD-71937 | 94.4 | 19.3 | 172-190 |
| AD-71938 | 90.8 | 1.8 | 188-206 |
| AD-71939 | 80.7 | 9.1 | 205-223 |
| AD-71940 | 67.2 | 2.3 | 223-241 |
| AD-71941 | 70.8 | 23.2 | 239-257 |
| AD-71942 | 49.6 | 8.9 | 273-291 |
| AD-71943 | 50.3 | 3.7 | 291-309 |
| AD-71944 | 52.9 | 6.5 | 308-326 |
| AD-71945 | 79.4 | 5.0 | 325-343 |
| AD-71946 | 92.7 | 0.1 | 342-360 |
| AD-71947 | 50.1 | 17.5 | 358-376 |
| AD-71948 | 65.1 | 19.8 | 376-394 |
| AD-71949 | 87.7 | 0.1 | 392-410 |
| AD-71950 | 44.1 | 2.8 | 410-428 |
| AD-71951 | 70.6 | 5.2 | 425-443 |
| AD-71952 | 43.5 | 4.0 | 444-462 |
| AD-71953 | 85.3 | 1.7 | 459-477 |
| AD-71954 | 56.1 | 7.2 | 477-495 |
| AD-71955 | 80.7 | 22.7 | 495-513 |
| AD-71956 | 81.6 | 9.6 | 510-528 |
| AD-71957 | 69.1 | 8.1 | 529-547 |
| AD-71958 | 60.6 | 2.7 | 544-562 |
| AD-71959 | 79.8 | 12.1 | 563-581 |
| AD-71960 | 68.4 | 16.0 | 580-598 |
| AD-71961 | 51.1 | 2.0 | 596-614 |
| AD-71962 | 52.0 | 0.7 | 630-648 |
| AD-71963 | 56.9 | 3.6 | 647-665 |
| AD-71964 | 52.4 | 3.4 | 663-681 |
| AD-71965 | 90.2 | 29.6 | 680-698 |
| AD-71966 | 53.2 | 5.5 | 697-715 |
| AD-71967 | 54.5 | 4.2 | 714-732 |
| AD-71968 | 53.3 | 3.2 | 731-749 |
| AD-71969 | 57.0 | 4.7 | 748-766 |
| AD-71970 | 72.1 | 10.5 | 765-783 |
| AD-71971 | 60.0 | 4.2 | 783-801 |
| AD-71972 | 86.7 | 6.8 | 799-817 |
| AD-71973 | 89.1 | 7.0 | 816-834 |
| AD-71974 | 65.9 | 6.2 | 834-852 |
| AD-71975 | 62.3 | 16.3 | 852-870 |
| AD-71976 | 75.7 | 22.3 | 869-887 |
| AD-71977 | 69.5 | 17.5 | 884-902 |
| AD-71978 | 112.9 | 17.2 | 902-920 |
| AD-71979 | 88.8 | 12.2 | 919-937 |
| AD-71980 | 47.2 | 20.4 | 936-954 |
| AD-71981 | 51.9 | 9.6 | 953-971 |
| AD-71982 | 46.5 | 1.2 | 969-987 |
| AD-71983 | 58.2 | 14.4 | 986-1004 |
| AD-71984 | 61.3 | 5.4 | 1005-1023 |
| AD-71985 | 78.2 | 7.6 | 1021-1039 |
| AD-71986 | 84.0 | 15.2 | 1037-1055 |
| AD-71987 | 66.6 | 4.0 | 1056-1074 |
| AD-71988 | 56.9 | 3.6 | 1071-1089 |
| AD-71989 | 61.2 | 31.8 | 1088-1106 |
| AD-71990 | 33.5 | 4.7 | 1105-1123 |
| AD-71991 | 77.8 | 4.1 | 1123-1141 |
| AD-71992 | 76.4 | 2.3 | 1141-1159 |
| AD-71993 | 34.5 | 16.4 | 1158-1176 |
| AD-71994 | 83.5 | 18.6 | 1173-1191 |
| AD-71995 | 53.3 | 2.1 | 1190-1208 |
| AD-71996 | 53.9 | 2.9 | 1207-1225 |
| AD-71997 | 83.6 | 1.6 | 1225-1243 |
| AD-71998 | 39.5 | 0.4 | 1242-1260 |
| AD-71999 | 58.1 | 7.4 | 1259-1277 |
| AD-72000 | 87.3 | 22.1 | 1277-1295 |
| AD-72001 | 89.2 | 9.7 | 1292-1310 |
| AD-72002 | 84.3 | 6.7 | 1310-1328 |
| AD-72003 | 40.5 | 6.9 | 1326-1344 |
| AD-72004 | 55.2 | 17.3 | 1343-1361 |
| AD-72005 | 66.6 | 20.9 | 1362-1380 |
| AD-72006 | 42.7 | 0.0 | 1378-1396 |
| AD-72007 | 32.6 | 6.0 | 1394-1412 |
| AD-72008 | 76.2 | 10.4 | 1411-1429 |
| AD-72009 | 57.3 | 2.5 | 1428-1446 |
| AD-72010 | 86.3 | 6.4 | 1445-1463 |
| AD-72011 | 56.5 | 13.4 | 1463-1481 |
| AD-72012 | 48.8 | 5.3 | 1481-1499 |
| AD-72013 | 52.2 | 1.6 | 1496-1514 |
| AD-72014 | 45.8 | 3.6 | 1515-1533 |
| AD-72015 | 46.1 | 5.6 | 1530-1548 |
| AD-72016 | 78.2 | 7.7 | 1548-1566 |
| AD-72017 | 100.3 | 8.8 | 1564-1582 |
| AD-72018 | 68.4 | 4.1 | 1583-1601 |
| AD-72019 | 90.5 | 1.4 | 1598-1616 |
| AD-71752 | 60.9 | 14.0 | 1617-1635 |
| AD-71753 | 63.1 | 2.1 | 1634-1652 |
| AD-71754 | 108.1 | 31.4 | 1667-1685 |
| AD-71755 | 84.4 | 21.3 | 1685-1703 |
| AD-71756 | 59.5 | 6.7 | 1702-1720 |
| AD-71757 | 48.5 | 0.7 | 1718-1736 |
| AD-71758 | 92.8 | 6.3 | 1734-1752 |
| AD-71759 | 73.0 | 7.8 | 1752-1770 |
| AD-71760 | 63.9 | 14.0 | 1770-1788 |
| AD-71761 | 108.8 | 2.1 | 1787-1805 |
| AD-71762 | 124.6 | 21.3 | 1803-1821 |
| AD-71763 | 55.1 | 0.0 | 1819-1837 |
| AD-71764 | 121.9 | 19.7 | 1836-1854 |
| AD-71765 | 41.8 | 7.0 | 1854-1872 |
| AD-71766 | 44.0 | 2.0 | 1872-1890 |
| AD-71767 | 51.3 | 0.7 | 1889-1907 |
| AD-71768 | 58.3 | 3.5 | 1921-1939 |
| AD-71769 | 53.5 | 9.7 | 1939-1957 |
| AD-71770 | 74.2 | 6.2 | 1973-1991 |
| AD-71771 | 60.7 | 13.6 | 1991-2009 |
| AD-71772 | 58.4 | 11.4 | 2040-2058 |
| AD-71773 | 77.4 | 12.1 | 2057-2075 |
| AD-71774 | 130.8 | 7.0 | 2075-2093 |
| AD-71775 | 75.8 | 7.8 | 2091-2109 |
| AD-71776 | 76.4 | 3.0 | 2110-2128 |
| AD-71777 | 76.0 | 27.4 | 2126-2144 |
| AD-71778 | 48.3 | 9.2 | 2142-2160 |
| AD-71779 | 43.1 | 10.8 | 2177-2195 |
| AD-71780 | 78.4 | 16.8 | 2194-2212 |
| AD-71781 | 71.2 | 14.3 | 2210-2228 |
| AD-71782 | 92.8 | 3.7 | 2228-2246 |
| AD-71783 | 60.8 | 19.1 | 2244-2262 |
| AD-71784 | 62.8 | 17.1 | 2263-2281 |
| AD-71785 | 58.7 | 13.7 | 2280-2298 |
| AD-71786 | 50.7 | 5.7 | 2295-2313 |
| AD-71787 | 46.7 | 5.2 | 2314-2332 |
| AD-71788 | 60.8 | 0.6 | 2331-2349 |
| AD-71789 | 105.1 | 1.0 | 2347-2365 |
| AD-71790 | 55.1 | 18.8 | 2364-2382 |
| AD-71791 | 72.4 | 10.2 | 2381-2399 |
| AD-71792 | 72.9 | 10.4 | 2399-2417 |
| AD-71793 | 61.5 | 5.2 | 2414-2432 |
| AD-71794 | 65.0 | 6.0 | 2431-2449 |
| AD-71795 | 69.6 | 23.1 | 2448-2466 |
| AD-71796 | 68.0 | 9.0 | 2467-2485 |
| AD-71797 | 67.8 | 18.4 | 2483-2501 |
| AD-71798 | 91.7 | 21.0 | 2500-2518 |
| AD-71799 | 57.4 | 9.0 | 2517-2535 |
| AD-71800 | 64.3 | 13.5 | 2550-2568 |
| AD-71801 | 40.3 | 9.0 | 2567-2585 |
| AD-71802 | 80.3 | 5.6 | 2586-2604 |
| AD-71803 | 51.1 | 6.2 | 2602-2620 |
| AD-71804 | 90.3 | 6.2 | 2618-2636 |
| AD-71805 | 51.4 | 5.3 | 2637-2655 |
| AD-71806 | 86.3 | 18.5 | 2654-2672 |
| AD-71807 | 68.8 | 7.7 | 2670-2688 |
| AD-71808 | 69.9 | 45.6 | 2686-2704 |
| AD-71809 | 51.2 | 7.3 | 2705-2723 |
| AD-71810 | 36.8 | 0.6 | 2722-2740 |
| AD-71811 | 52.1 | 4.3 | 2739-2757 |

TABLE 8-continued

XDH Single Dose (10 nM) Screen in Primary Human Hepatocytes

| Duplex Name | AVG | STDEV | Position in NM_000379.3 |
|---|---|---|---|
| AD-71812 | 76.9 | 9.4 | 2754-2772 |
| AD-71813 | 55.9 | 2.2 | 2773-2791 |
| AD-71814 | 68.7 | 14.7 | 2788-2806 |
| AD-71815 | 90.8 | 18.1 | 2805-2823 |
| AD-71816 | 71.1 | 9.0 | 2823-2841 |
| AD-71817 | 87.4 | 9.4 | 2840-2858 |
| AD-71818 | 67.1 | 15.4 | 2858-2876 |
| AD-71819 | 79.7 | 16.7 | 2875-2893 |
| AD-71820 | 38.2 | 0.7 | 2891-2909 |
| AD-71821 | 58.9 | 18.2 | 2909-2927 |
| AD-71822 | 55.7 | 18.0 | 2924-2942 |
| AD-71823 | 45.3 | 3.3 | 2941-2959 |
| AD-71824 | 57.1 | 6.9 | 2958-2976 |
| AD-71825 | 68.3 | 7.7 | 2977-2995 |
| AD-71826 | 47.3 | 11.1 | 2993-3011 |
| AD-71827 | 51.6 | 6.0 | 3011-3029 |
| AD-71828 | 51.5 | 1.5 | 3026-3044 |
| AD-71829 | 85.5 | 6.7 | 3044-3062 |
| AD-71830 | 43.1 | 1.9 | 3062-3080 |
| AD-71831 | 36.7 | 2.9 | 3079-3097 |
| AD-71832 | 77.0 | 4.6 | 3095-3113 |
| AD-71833 | 44.9 | 4.0 | 3112-3130 |
| AD-71834 | 41.7 | 2.7 | 3129-3147 |
| AD-71835 | 53.3 | 1.6 | 3146-3164 |
| AD-71836 | 52.5 | 1.0 | 3164-3182 |
| AD-71837 | 39.1 | 0.2 | 3197-3215 |
| AD-71838 | 93.7 | 2.2 | 3215-3233 |
| AD-71839 | 55.6 | 2.8 | 3230-3248 |
| AD-71840 | 42.4 | 15.8 | 3247-3265 |
| AD-71841 | 69.4 | 24.3 | 3266-3284 |
| AD-71842 | 69.6 | 1.7 | 3281-3299 |
| AD-71843 | 51.5 | 1.0 | 3298-3316 |
| AD-71844 | 43.0 | 0.9 | 3316-3334 |
| AD-71845 | 58.5 | 0.8 | 3333-3351 |
| AD-71846 | 73.4 | 7.1 | 3350-3368 |
| AD-71847 | 45.4 | 0.0 | 3366-3384 |
| AD-71848 | 65.6 | 13.7 | 3384-3402 |
| AD-71849 | 105.6 | 19.0 | 3401-3419 |
| AD-71850 | 69.2 | 12.5 | 3419-3437 |
| AD-71851 | 54.0 | 2.2 | 3434-3452 |
| AD-71852 | 51.1 | 6.3 | 3452-3470 |
| AD-71853 | 71.3 | 1.4 | 3470-3488 |
| AD-71854 | 48.8 | 0.3 | 3487-3505 |
| AD-71855 | 48.2 | 13.7 | 3502-3520 |
| AD-71856 | 59.5 | 7.3 | 3521-3539 |
| AD-71857 | 54.2 | 6.4 | 3538-3556 |
| AD-71858 | 51.4 | 12.0 | 3555-3573 |
| AD-71859 | 52.3 | 8.5 | 3570-3588 |
| AD-71860 | 62.1 | 13.0 | 3588-3606 |
| AD-71861 | 39.3 | 2.7 | 3606-3624 |
| AD-71862 | 67.9 | 2.7 | 3621-3639 |
| AD-71863 | 56.4 | 3.9 | 3639-3657 |
| AD-71864 | 78.6 | 4.6 | 3657-3675 |
| AD-71865 | 49.1 | 4.8 | 3672-3690 |
| AD-71866 | 59.1 | 2.3 | 3690-3708 |
| AD-71867 | 50.9 | 5.4 | 3706-3724 |
| AD-71868 | 60.3 | 6.2 | 3724-3742 |
| AD-71869 | 76.3 | 12.0 | 3740-3758 |
| AD-71870 | 68.1 | 6.6 | 3758-3776 |
| AD-71871 | 108.2 | 8.5 | 3776-3794 |
| AD-71872 | 75.4 | 21.9 | 3808-3826 |
| AD-71873 | 59.2 | 8.4 | 3826-3844 |
| AD-71874 | 69.0 | 10.4 | 3842-3860 |
| AD-71875 | 68.1 | 11.6 | 3859-3877 |
| AD-71876 | 60.1 | 11.7 | 3876-3894 |
| AD-71877 | 89.9 | 3.1 | 3893-3911 |
| AD-71878 | 49.8 | 11.3 | 3912-3930 |
| AD-71879 | 73.0 | 1.7 | 3928-3946 |
| AD-71880 | 91.3 | 7.5 | 3944-3962 |
| AD-71881 | 125.0 | 7.3 | 3962-3980 |
| AD-71882 | 107.5 | 9.5 | 3979-3997 |
| AD-71883 | 67.6 | 7.3 | 3995-4013 |
| AD-71884 | 55.4 | 7.6 | 4013-4031 |
| AD-71885 | 66.6 | 5.9 | 4029-4047 |
| AD-71886 | 79.7 | 3.1 | 4048-4066 |
| AD-71887 | 47.0 | 9.8 | 4063-4081 |
| AD-71888 | 102.9 | 3.1 | 4080-4098 |
| AD-71889 | 51.2 | 10.0 | 4098-4116 |
| AD-71890 | 48.9 | 1.2 | 4114-4132 |
| AD-71891 | 55.7 | 6.0 | 4150-4168 |
| AD-71892 | 69.5 | 11.2 | 4165-4183 |
| AD-71893 | 67.3 | 9.9 | 4183-4201 |
| AD-71894 | 46.7 | 4.8 | 4200-4218 |
| AD-71895 | 64.3 | 15.6 | 4218-4236 |
| AD-71896 | 110.4 | 32.1 | 4233-4251 |
| AD-71897 | 60.4 | 1.8 | 4250-4268 |
| AD-71898 | 63.0 | 5.0 | 4269-4287 |
| AD-71899 | 55.0 | 3.0 | 4285-4303 |
| AD-71900 | 45.6 | 2.0 | 4303-4321 |
| AD-71901 | 49.7 | 0.9 | 4319-4337 |
| AD-71902 | 85.9 | 26.2 | 4336-4354 |
| AD-71903 | 54.4 | 17.8 | 4352-4370 |
| AD-71904 | 71.3 | 2.1 | 4369-4387 |
| AD-71905 | 49.8 | 3.9 | 4386-4404 |
| AD-71906 | 66.9 | 6.3 | 4404-4422 |
| AD-71907 | 63.6 | 8.7 | 4422-4440 |
| AD-71908 | 57.2 | 8.6 | 4438-4456 |
| AD-71909 | 56.2 | 10.6 | 4456-4474 |
| AD-71910 | 52.5 | 6.5 | 4471-4489 |
| AD-71911 | 51.1 | 15.5 | 4489-4507 |
| AD-71912 | 64.7 | 23.6 | 4506-4524 |
| AD-71913 | 50.1 | 8.8 | 4524-4542 |
| AD-71914 | 49.9 | 5.8 | 4541-4559 |
| AD-71915 | 82.6 | 20.9 | 4558-4576 |
| AD-71916 | 67.3 | 21.4 | 4574-4592 |
| AD-71917 | 74.4 | 34.4 | 4592-4610 |
| AD-71918 | 77.8 | 14.0 | 4607-4625 |
| AD-71919 | 116.4 | 22.2 | 4626-4644 |
| AD-71920 | 78.8 | 18.0 | 4641-4659 |
| AD-71921 | 100.5 | 5.4 | 4659-4677 |
| AD-71922 | 61.7 | 3.7 | 4676-4694 |
| AD-71923 | 72.1 | 4.6 | 4694-4712 |
| AD-71924 | 57.0 | 5.9 | 4710-4728 |
| AD-71925 | 74.1 | 2.6 | 4728-4746 |
| AD-71926 | 56.9 | 0.2 | 4743-4761 |
| AD-71927 | 70.8 | 8.6 | 4761-4779 |
| AD-71928 | 106.9 | 17.1 | 4777-4795 |
| AD-71929 | 90.1 | 8.4 | 4795-4813 |
| AD-72020 | 86.0 | 3.3 | 4811-4829 |
| AD-72021 | 69.7 | 18.9 | 4828-4846 |
| AD-72022 | 82.9 | 12.2 | 4845-4863 |
| AD-72023 | 99.1 | 4.4 | 4864-4882 |
| AD-72024 | 81.9 | 10.9 | 4881-4899 |
| AD-72025 | 101.1 | 1.4 | 4896-4914 |
| AD-72026 | 106.2 | 3.6 | 4915-4933 |
| AD-72027 | 88.7 | 4.0 | 4930-4948 |
| AD-72028 | 91.2 | 5.9 | 4947-4965 |
| AD-72029 | 84.2 | 3.4 | 4965-4983 |
| AD-72030 | 121.3 | 30.1 | 4981-4999 |
| AD-72031 | 95.1 | 5.1 | 4999-5017 |
| AD-72032 | 82.7 | 0.4 | 5017-5035 |
| AD-72033 | 83.0 | 3.2 | 5034-5052 |
| AD-72034 | 64.8 | 12.6 | 5051-5069 |
| AD-72035 | 94.7 | 10.7 | 5068-5086 |
| AD-72036 | 92.1 | 2.7 | 5083-5101 |
| AD-72037 | 78.6 | 3.9 | 5118-5136 |
| AD-72038 | 85.2 | 6.3 | 5134-5152 |
| AD-72039 | 87.5 | 2.9 | 5152-5170 |
| AD-72040 | 69.6 | 8.1 | 5170-5188 |
| AD-72041 | 80.7 | 0.0 | 5186-5204 |
| AD-72042 | 83.3 | 28.8 | 5202-5220 |
| AD-72043 | 107.3 | 0.1 | 5220-5238 |
| AD-72044 | 100.8 | 4.9 | 5237-5255 |
| AD-72045 | 145.2 | 42.9 | 5272-5290 |
| AD-72046 | 76.9 | 12.7 | 5288-5306 |
| AD-72047 | 62.9 | 1.3 | 5339-5357 |
| AD-72048 | 66.6 | 5.3 | 5372-5390 |
| AD-72049 | 74.6 | 2.5 | 5391-5409 |
| AD-72050 | 96.8 | 32.6 | 5407-5425 |
| AD-72051 | 76.7 | 4.2 | 5440-5458 |

TABLE 8-continued

XDH Single Dose (10 nM) Screen in Primary Human Hepatocytes

| Duplex Name | AVG | STDEV | Position in NM_000379.3 |
|---|---|---|---|
| AD-72052 | 91.9 | 6.7 | 5459-5477 |
| AD-72053 | 67.5 | 16.4 | 5474-5492 |
| AD-72054 | 85.9 | 0.9 | 5491-5509 |
| AD-72055 | 99.8 | 5.4 | 5510-5528 |
| AD-72056 | 111.5 | 2.8 | 5525-5543 |
| AD-72057 | 98.9 | 9.6 | 5544-5562 |
| AD-72058 | 82.8 | 19.6 | 5560-5578 |
| AD-72059 | 89.5 | 33.9 | 5578-5596 |
| AD-72060 | 91.8 | 0.5 | 5595-5613 |
| AD-72061 | 104.8 | 18.8 | 5612-5630 |
| AD-72062 | 73.9 | 5.0 | 5644-5662 |
| AD-72063 | 98.7 | 19.8 | 5663-5681 |
| AD-72064 | 84.8 | 14.9 | 5678-5696 |
| AD-72065 | 77.7 | 15.9 | 5695-5713 |

Example 4. In Vitro Determination $IC_{50}$ Values of XDH iRNA Agents in Cynomolgus Monkey and Mouse Primary Hepatocytes A series of siRNA-GalNAc3conjugates targeting an XDH gene were analyzed for target knockdown in cynomolgus monkey and mouse primary hepatocytes. The results are provided as $IC_{50}$ (nM) in Table 9.

TABLE 9

XDH siRNA $IC_{50}$ Values in Primary Cynomolgus Monkey and Mouse Hepatocytes

| Duplex | Cyno | Mouse |
|---|---|---|
| AD-70042 | 0.0047 | >10 nM |
| AD-70016 | 0.006 | 0.2345 |
| AD-70030 | 0.0209 | >10 nM |
| AD-70044 | 0.0224 | >10 nM |
| AD-70050 | 0.0524 | >10 nM |
| AD-70055 | 0.055 | >10 nM |
| AD-70033 | 0.0569 | 0.1231 |
| AD-70026 | 0.0614 | 0.1901 |
| AD-70051 | 0.0859 | >10 nM |
| AD-70052 | 0.1409 | >10 nM |
| AD-70020 | 0.4017 | 4.4548 |
| AD-70018 | 0.5446 | 0.8168 |
| AD-70023 | 0.6569 | 0.4775 |
| AD-70024 | >10 nM | 0.5886 |

Example 5. In Vivo Effect of Single Dose Administration of XDH iRNA Agents in Mice A series of siRNA-GalNAc3conjugates targeting an XDH gene were designed and tested for the ability to knockdown expression of XDH mRNA in 6-8 week old C57BL/6 female mice (n=3 per group). A single 1 mg/kg dose of AD-70016, AD-70018, AD-70020, AD-70023, AD-70026, AD-70030, AD-70033; or PBS control, was administered subcutaneously to the mice on day 1. On day 10, the mice were sacrificed to assess knockdown of XDH mRNA in liver by RT-PCR. The effect of a single dose of the indicated agents are provided in Table 10. The data are presented as the XDH mRNA level remaining relative to PBS.

TABLE 10

XDH siRNA Single Dose (1 mg/kg) mRNA Knockdown in Mouse Liver

| siRNA | Relative mRNA | St. Dev. |
|---|---|---|
| PBS | 100.0 | 4.43 |
| AD-70016 | 22.73 | 6.03 |
| AD-70018 | 65.93 | 8.83 |
| AD-70020 | 88.98 | 35.71 |
| AD-70023 | 50.14 | 22.53 |
| AD-70026 | 62.25 | 1.99 |
| AD-70030 | 84.46 | 10.67 |
| AD-70033 | 36.57 | 9.98 |

Example 6. In Vivo Effect of Increasing Single Dose Administration of XDH iRNA Agents in Mice Male mice typically have higher serum levels of uric acid than female mice. Therefore, the ability of dsRNA agents targeting XDH to knockdown XDH was also assessed in male mice. Of the duplexes tested, AD-70016 was found to be most effective in decreasing expression of XDH mRNA and was subsequently analyzed in a dose-response study. C57BL/6 male mice, 6-8 weeks of age (n=3-4 per group) were administered a single dose of AD-70016 at 10, 3, 1, 0.3, or 0.1 mg/kg; or a PBS control. On day 10, the mice were sacrificed to assess knockdown of XDH mRNA in liver by RT-PCR. The effects of a single dose of AD-70016 at the concentrations indicated are provided in Table 10. The data are presented as the XDH mRNA level remaining relative to PBS.

TABLE 11

XDH siRNA AD-70016 Single Dose mRNA Knockdown Dose Response in Mouse Liver

| mg/kg | Relative mRNA | St. Dev. |
|---|---|---|
| 0 (PBS) | 100.0 | 11.28 |
| 10 | 14.89 | 1.53 |
| 3 | 15.54 | 3.95 |
| 1 | 29.71 | 5.32 |
| 0.3 | 52.12 | 7.01 |
| 0.1 | 73.13 | 7.64 |

Further studies demonstrated the durability of knockdown by AD-70016 for at least 6 weeks post a single 10 mg/kg dose in C57BL/6 male mice.

Finally, in a single dose study using higher doses of GalNAc3 conjugated AD-70016 (3 mg/kg, 10 mg/kg, and 30 mg/kg), achieved robust knockdown of mRNA at day 10 (15.35%, 9.42%, and 8.29% remaining, respectively).

Example 7. In Vivo Effect of Increasing Single Dose Administration of XDH iRNA Agents in Rats The AD-70016-GalNAc conjugate, which has a single nucleotide mismatch to the rat XDH sequence, was analyzed in a dose-response study in rats. Male Sprague-Dawley rats, 6-8 weeks of age (n=4 per group) were administered a single dose of AD-70016 at 15, 5, 1.5, 0.5, or 0.15 mg/kg; or a PBS control. On day 10, the rats were sacrificed to assess knockdown of XDH mRNA in liver by RT-PCR. The effects of a single dose of AD-70016 at the concentrations indicated are provided in Table 11. The data are presented as the XDH mRNA level remaining relative to PBS.

TABLE 12

XDH siRNA AD-70016 Single Dose mRNA Knockdown Dose Response in Rat Liver

| mg/kg | Relative mRNA | St. Dev. |
|---|---|---|
| 0 (PBS) | 100 | 17.98 |
| 15 | 19.01 | 4.92 |
| 5 | 13.74 | 2.08 |
| 1.5 | 31.97 | 7.20 |
| 0.5 | 45.14 | 8.32 |
| 0.15 | 63.74 | 8.28 |

The results demonstrate that AD-70016 is effective in knocking down XDH expression in rats.

EQUIVALENTS

Those skilled in the art will recognize, or be able to ascertain using no more than routine experimentation, many equivalents to the specific embodiments and methods described herein. Such equivalents are intended to be encompassed by the scope of the following claims.

SEQUENCE LISTING (1932 sequences)

SEQ ID NO: 1 - DNA, 5717 bp, Homo sapiens
gtcacagagcagtgataactacctgccagtgtctcttaggagtgaggtacctggagttcggggaccccaacctgtgacaatgacagcagacaaattggttttctttgtgaatggcagaaaggtggtggagaaaaatgcagatccagagacaacccttttggcctacctgagaagaaagttggggctgagtggaaccaagctcggctgtggagaggggggctgcggggcttgcacagtgatgctctccaagtatgatcgtctgcagaacaagatcgtccacttttctgccaatgcctgcctggcccccatctgctccttgcaccatgttgcagtgacaactgtggaaggaataggaagcaccaagacgaggctgcatcctgtgcaggagagaattgccaaaagccacggctcccagtgcgggttctgcacccctggcatcgtcatgagtatgtacacactgctccggaatcagcccgagcccaccatggaggagattgagaatgccttccaaggaaatctgtgccgctgcacaggctacagacccatcctccagggcttccggacctttgccagggatggtggatgctgtggaggagatgggaataatccaaattgctgcatgaaccagaagaaagaccactcagtcagcctctcgccatctttattcaaaccagaggagttcacgcccctggatccaacccaggagcccatttttcccccagagttgctgaggctgaaagacactcctcggaagcagctgcgatttgaaggggagcgtgtgacgtggatacaggcctcaaccctcaaggagctgctggacctcaaggctcagcaccctgacgccaagctggtcgtggggaacacggagattggcattgagatgaagttcaagaatatgctgtttcctatgattgtctgcccagcctggatccctgagctgaattcggtagaacatggacccgacggtatctcctttggagctgcttgccccctgagcattgtggaaaaaaccctggtggatgctgttgctaagcttcctgcccaaaagacagaggtgttcagaggggtcctggagcagctgcgctggtttgctgggaagcaagtcaagtctgtggcgtccgttggagggaacatcatcactgccagccccatctccgacctcaaccccgtgttcatggccagtggggccaagctgacacttgtgtccagaggcaccaggagaactgtccagatggaccacaccttcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtacaggagctggccctttgctatggtggaatggccaacagaaccatctcagccctcaagaccactcagaggcagctttccaagctctggaaggaggagctgctgcaggacgtgtgtgcaggactggcagaggagctgcatctgcctcccgatgcccctggtggcatggtggacttccggtgcaccctcaccctcagcttcttcttcaagttctacctgacagtccttcagaagctgggccaagagaacctggaagacaagtgtggtaaactggaccccactttcgccagtgcaactttactgtttcagaaagaccccccagccgatgtccagctcttccaagaggtgcccaagggtcagtctgaggaggacatggtgggccggcccctgccccacctggcagcggacatgcaggcctctggtgaggccgtgtactgtgacgacattcctcgctacgagaatgagctgtctctccggctggtcaccagcacccgggcccacgccaagatcaagtccatagatacatcagaagctaagaaggttccagggtttgtttgtttcatttccgctgatgatgttcctgggagtaacataactggaatttgtaatgatgagacagtctttgcgaaggataaggttacttgtgttgggcatatcattggtgctgtggttgctgacaccccggaacacacacagagagctgcccaaggggtgaaaatcacctatgaagaactaccagccattatcacaattgaggatgctataaagaacaactccttttatggacctgagctgaagatcgagaaaggggacctaaagaaggggttttccgaagcagataatgttgtgtcaggggagatatacatcggtggccaagagcacttctacctggagactcactgcaccattgctgttccaaaaggcgaggcaggggagatggagctctttgtgtctacacagaacaccatgaagacccagagctttgttgcaaaaatgttgggggttccagcaaaccggattgtggttcgagtgaagagaatgggaggaggctttggaggcaaggagacccggagcactgtggtgtccacggcagtggccctggctgcatataagaccggccgccctgtgcgatgcatgctggaccgtgatgaggacatgctgataactggtggcagacatcccttcctggccagatacaaggttggcttcatgaagactgggacagttgtggctcttgaggtggaccacttcagcaatgtggggaacacccaggatctctctcagagtattatggaacgagctttattccacatggacaactgctataaaatccccaacatccggggcactgggcggctgtgcaaaaccaaccttccctccaacacggccttccggggctttggggggccccaggggatgctcattgccgagtgctggatgagtgaagttgcagtgacctgtgggatgcctgcagaggaggtgcggagaaaaaacctgtacaaagaaggggacctgacacacttcaaccagaagcttgagggtttcaccttgcccagatgctgggaagaatgcctagcaagctctcagtatcatgctcggaagagtgaggttgacaagttcaacaaggagaattgttggaaaaagagaggattgtgcataattcccaccaagtttggaataagctttacagttccttttctgaatcaggcaggagccctacttcatgtgtacacagatggctctgtgctgctgacccacggggggactgagatgggccaaggccttcataccaaaatggtccaggtggccagtagagctctgaaaatccccacctctaagatttatatcagcgagacaagcactaacactgtgcccaacacctctcccacggctgcctctgtcagcgctgacctcaatggacaggccgtctatgcggcttgtcagaccatcttgaaaaggctggaaccctacaagaagaagaatcccagtggctcctgggaagactgggtcacagctgcctacatggacacagtgagcttgtctgccactgggttttatagaacacccaatctgggctacagctttgagactaactcagggaaccccttccactacttcagctatggggtggcttgctctgaagtagaaatcgactgcctaacaggagatcataagaacctccgcacagatattgtcatggatgttggctccagtctaaaccctgccattgatattggacaggtggaaggggcatttgtccagggccttggcctcttcaccctagaggagctacactattcccccgaggggagcctgcacacccgtggccctagcacctacaagatcccggcatttggcagcatccccattgagttcagggtgtccctgctccgcgactgccccaacaagaaggccatctatgcatcgaaggctgttggagagccgcccctcttcctggctgcttctatcttctttgccatcaaagatgccatccgtgcagctcgagctcagcacacaggtaataacgtgaaggaactcttccggctagacagccctgccaccccggagaagatccgcaatgcctgcgtggacaagttcaccaccctgtgtgtcactggtgtcccagaaaactgcaaaccctggtctgtgagggtctaaagagagagtcctcagcagagtcttcttgtgctgcctttgggcttccatggagcaggaggaacataccacagaacatggatctattaaagtcacagaatgacagacctgtgatttgtcaagatgggatttggaagacaagtgaatgcaatggaagattttgatcaaaaatgtaatttgtaaacacaatgataagcaaattcaaaactgttatgcctaaatggtgaatatgcaattaggatcattttctgtctgttttaatcatgtatctggaatagggtcgggaagggtttgtgctattccccacttactggacagcctgtataacctcaagttctgatggtgtctgtcctttgaagaggattcccacaaacctctagaagcttaaaccgaagttactttaaatcgtgtgccttcctgtgaaagcctggccttcaaaccaatgaacagcaaagcataaccttgaatctatactcaaattttgcaatgaggcagtggggtaaggttaaatcctctaaccatctttgaatcattggaaagaataaagaatgaaacaaattcaaggttaattggatctgattttgtgaagctgcataaagcaagattactctataatacaaaaatccaaccaactcaattattgagcacgtacaatgttctagatttctttcccttcctctttgaagagaatatttgtattccaaatactctttgagtatttacaaaaaagattatgtttaatctttacatttgaagccaaagtaatttccacctagaaatgatgctatcagtcctggcatggtggctcacccctataatcccagcactttgggaggctaaggcaggagaattgcttgagcccagcagtttgagaccagcctgggcaacatagagagctcctgtctttaaaaaaaatttttttaattagttggtcttgatagtgcatgcctgtagtcccaactacttgaaaggctgaggtggagagatcatttgagctcaggaggttgaggctgcagtgagctatgattgcgccactgcactcctgcctgagcgactgagcaagatcttgtctctgaagaaaaaaaaagaaataaaaatgctgctatcaaaatcaagcccaaccagaggtagaagagccaagaagcctgggttctcatcctagctctgtctcttctgtctctatctttgtgatcttggactgtcaattccccttcctgtgatccattttactgcaaacataagggttgcagtaaagggttgtctcacgtcttctgctttaaaagcctataaatatatgacctgaaaactccagttacataaaggatctgcagctatctaaggcttggttttcttactgtcatatgatacctgggtctaatgaactctgctgagatcacctcaagtttctgcggttggtaaagagaacaagggaagaacaaacatcccttttattgctccaaatggtgatttaatccctacatggtgctgggtggacaatgtgtcactgtcacatgccttcactgtataaatccaaccttctgccagagagaatctgtggttctggccatggagggaggatagtggaaatgatatagttggactggtgcttgatgtcactaataaatgaaactgtcagctg

SEQ ID NO: 2 - DNA, 5717 bp, Homo sapiens
cagctgacagtttcatttattagtgacatcaagcaccagtccaactatatcatttccactatcctccctccatggccagaaccacagattctctctggcagaaggttggatttatacagtgaaggcatgtgacagtgacacattgtccacccagcaccatgtagggattaaatcaccatttggagcaataaaagggatgtttgttcttcccttgttctctttaccaaccgcagaaacttgaggtgatctcagcagagttcattagacccaggtatcatatgacagtaagaaaaccaagccttagatagctgcagatcctttatgtaactggagttttcaggtcatatatttataggcttttaaagcagaagacgtgagacaaccctttactgcaacccttatgtttgcagtaaaatggatcacaggaaggggaattgacagtccaagatcacaaagatagagacagaagagacagagctaggatgagaacccaggcttcttggctcttctacctctggttgggcttgattttgatagcagcatttttatttctttttttttcttcagagacaagatcttgctcagtcgctcaggcaggagtgcagtggcgcaatcatagctcactgcagcctcaacctcctgagctcaaatgatctctccacctcagcctttcaagtagttgggactacaggcatgcactatcaagaccaactaattaaaaaaattttttttaaagacaggagctctctatgttgcccaggctggtctcaaactgctgggctcaagcaattctcctgccttagcctcccaaagtgctgggattataggggtgagccaccatgccaggactgatagcatcatttctaggtggaaattactttggcttcaaatgtaaagattaaacataatcttttttgtaaatactcaaagagtatttggaatacaaatattctcttcaaagaggaagggaaagaaatctagaacattgtacgtgctcaataattgagttggttggatttttgtattatagagtaatcttgctttatgcagcttcacaaaatcagatccaattaaccttgaatttgtttcattctttattctttccaatgattcaaagatggttagaggatttaaccttaccccactgcctcattgcaaaatttgagtatagattcaaggttatgctttgctgttcattggtttgaaggccaggctttcacaggaaggcacacgatttaaagtaacttcggtttaagcttctagaggtttgtgggaatcctcttcaaaggacagacaccatcagaacttgaggttatacaggctgtccagtaagtggggaatagcacaaacccttcccgaccctattccagatacatgattaaaacagacagaaaatgatcctaattgcatattcaccatttaggcataacagttttgaatttgcttatcattgtgtttacaaattacatttttgatcaaaatcttccattgcattcacttgtcttccaaatcccatcttgacaaatcacaggtctgtcattctgtgactttaatagatccatgttctgtggtatgttcctcctgctccatggaagcccaaaggcagcacaagaagactctgctgaggactctctctttagaccctcacagaccagggtttgcagttttctgggacaccagtgacacacagggtggtgaacttgtccacgcaggcattgcggatcttctccggggtggcagggctgtctagccggaagagttccttcacgttattacctgtgtgctgagctcgagctgcacggatggcatctttgatggcaaagaagatagaagcagccaggaagaggggcggctctccaacagccttcgatgcatagatggccttcttgttggggcagtcgcggagcagggacaccctgaactcaatggggatgctgccaaatgccgggatcttgtaggtgctagggccacgggtgtgcaggctcccctcgggggaatagtgtagctcctctagggtgaagaggccaaggccctggacaaatgccccttccacctgtccaatatcaatggcagggtttagactggagccaacatccatgacaatatctgtgcggaggttcttatgatctcctgttaggcagtcgatttctacttcagagcaagccaccccatagctgaagtagtggaaggggttccctgagttagtctcaaagctgtagcccagattgggtgttctataaaacccagtggcagacaagctcactgtgtccatgtaggcagctgtgacccagtcttcccaggagccactgggattcttcttcttgtagggttccagccttttcaagatggtctgacaagccgcatagacggcctgtccattgaggtcagcgctgacagaggcagccgtgggagaggtgttgggcacagtgttagtgcttgtctcgctgatataaatcttagaggtggggattttcagagctctactggccacctggaccattttggtatgaaggccttggcccatctcagtccccccgtgggtcagcagcacagagccatctgtgtacacatgaagtagggctcctgcctgattcagaaaaggaactgtaaagcttattccaaacttggtgggaattatgcacaatcctctctttttccaacaattctccttgttgaacttgtcaacctcactcttccgagcatgatactgagagcttgctaggcattcttcccagcatctgggcaaggtgaaaccctcaagcttctggttgaagtgtgtcaggtccccttctttgtacaggttttttctccgcacctcctctgcaggcatcccacaggtcactgcaacttcactcatccagcactcggcaatgagcatcccctggggccccccaaagccccggaaggccgtgttggagggaaggttggttttgcacagccgcccagtgccccggatgttggggattttatagcagttgtccatgtggaataaagctcgttccataatactctgagagagatcctgggtgttccccacattgctgaagtggtccacctcaagagccacaactgtcccagtcttcatgaagccaaccttgtatctggccaggaagggatgtctgccaccagttatcagcatgtcctcatcacggtccagcatgcatcgcacagggcggccggtcttatatgcagccagggccactgccgtggacaccacagtgctccgggtctccttgcctccaaagcctcctcccattctcttcactcgaaccacaatccggtttgctggaacccccaacatttttgcaacaaagctctgggtcttcatggtgttctgtgtagacacaaagagctccatctcccctgcctcgccttttggaacagcaatggtgcagtgagtctccaggtagaagtgctcttggccaccgatgtatatctcccctgacacaacattatctgcttcggaaaaccccttctttaggtcccctttctcgatcttcagctcaggtccataaaaggagttgttctttatagcatcctcaattgtgataatggctggtagttcttcataggtgattttcaccccttgggcagctctctgtgtgtgttccggggtgtcagcaaccacagcaccaatgatatgcccaacacaagtaaccttatccttcgcaaagactgtctcatcattacaaattccagttatgttactcccaggaacatcatcagcggaaatgaaacaaacaaaccctggaaccttcttagcttctgatgtatctatggacttgatcttggcgtgggcccgggtgctggtgaccagccggagagacagctcattctcgtagcgaggaatgtcgtcacagtacacggcctcaccagaggcctgcatgtccgctgccaggtggggcaggggccggcccaccatgtcctcctcagactgacccttgggcacctcttggaagagctggacatcggctggggggtctttctgaaacagtaaagttgcactggcgaaagtggggtccagtttaccacacttgtcttccaggttctcttggcccagcttctgaaggactgtcaggtagaacttgaagaagaagctgagggtgagggtgcaccggaagtccaccatgccaccaggggcatcgggaggcagatgcagctcctctgccagtcctgcacacacgtcctgcagcagctcctccttccagagcttggaaagctgcctctgagtggtcttgagggctgagatggttctgttggccattccaccatagcaaagggccagctcctgtacctctgtggttcctggcttgaataaaactctcatgccactggttaccttggcaatgtcatcttctctccgggaggcctgcttgaatgctgagaaatactccccctccctgctgtaggggatctctatggagagcagtatctcctccgggctcagcagggtctttctgtagccagggaagaaggtgtggtccatctggacagttctcctggtgcctctggacacaagtgtcagcttggccccactggccatgaacacggggttgaggtcggagatggggctggcagtgatgatgttccctccaacggacgccacagacttgacttgcttcccagcaaaccagcgcagctgctccaggacccctctgaacacctctgtcttttgggcaggaagcttagcaacagcatccaccagggttttttccacaatgctcagggggcaagcagctccaaaggagataccgtcgggtccatgttctaccgaattcagctcagggatccaggctgggcagacaatcataggaaacagcatattcttgaacttcatctcaatgccaatctccgtgttccccacgaccagcttggcgtcagggtgctgagccttgaggtccagcagctccttgagggttgaggcctgtatccacgtcacacgctccccttcaaatcgcagctgcttccgaggagtgtctttcagcctcagcaactctgggggaaaaatgggctcctgggttggatccaggggcgtgaactcctctggtttgaataaagatggcgagaggctgactgagtggtctttcttctggttcatgcagcaatttggattattcccatctcctccacagcatccaccatccctggcaaaggtccggaagccctggaggatgggtctgtagcctgtgcagcggcacagatttccttggaaggcattctcaatctcctccatggtgggctcgggctgattccggagcagtgtgtacatactcatgacgatgccaggggtgcagaacccgcactgggagccgtggcttttggcaattctctcctgcacaggatgcagcctcgtcttggtgcttcctattccttccacagttgtcactgcaacatggtgcaaggagcagatgggggccaggcaggcattggcagaaaagtggacgatcttgttctgcagacgatcatacttggagagcatcactgtgcaagccccgcagcccccctctccacagccgagcttggttccactcagccccaactttcttctcaggtaggccaaaagggttgtctctggatctgcatttttctccaccacctttctgccattcacaaagaaaaccaatttgtctgctgtcattgtcacaggttggggtccccgaactccaggtacctcactcctaagagacactggcaggtagttatcactgctctgtgac

SEQ ID NO: 3 - DNA, 4623 bp, Mus musculus
atctttcaagttgcaggcagtgatatctacaagcacctcgcagcagctcggggactccggccgtcacgatgacgaggacaacggtagatgagttggtcttctttgtgaatggcaaaaaggtggtggagaaaaatgcagaccctgaaacaacacttctggtctaccttagaagaaagttggggctgtgcgggaccaagcttggctgtggagaaggtggctgtggggcatgcaccgtgatgatctccaagtatgaccgccttcagaacaagatcgttcatttttccgtcaatgcctgcttgacccccatctgctccttgcatcatgttgctgtgacaactgtggaaggcataggaaacaccaagaagctgcatcctgtccaggagagaattgccaaaagccatggttcccagtgtgggttctgtacccctggtattgtcatgagtatgtacacactgctccgaaacaagcctgagcctactgtcgaggagatcgagaatgccttccaaggaaacctctgccgctgtacaggctatagacccatcctccagggattccggacctttgccaaggatggtgggtgctgtggaggaagtggaaacaacccaaactgctgcatgagccaaacaaaggaccagacgattgctccctcatcttctttattcaacccggaggatttcaaacctttagatcccacccaagagcccatctttcccccagagttgctgaggctgaaagacactccccggaagacgttgcgttttgaaggggaacgtgtgacctggatccaggtttcaaccatggaggaactgcttgacctcaaagcccagcaccctgatgccaagctggtggtgggaaacacagagataggcattgaaatgaaatttaaaaatatgctatttcctctgatcatctgcccagcctggatccttgaactgacctcagtggcacatgggcctgagggaatctcctttggagccgcttgcccccttagcttggtggaaagtgtcctggcggacgcgattgctacacttccagagcagaggacagaggtgttcagaggcgtgatggagcagctgcgctggtttgctggcaagcaggtcaagtccgtggcgtccattggcgggaacatcatcaccgcgagccccatctctgacctcaaccctgtgctcatggccagtcgagccaagctgaccctcgcatctagaggtaccaagagaacggtctggatggaccataccttcttccctggctatagaaggactctgctcagtccagaggagatattggtgtccattgtgatcccctacagcaggaagggtgagtttttctcagccttcaagcaggcctccaggagagaagatgacattgccaaggtgaccagtggcatgagagtcctgttcaagccagggaccactgaagtgcaggaactgtccctttgctttggagggatggctgacagaactgtctcagccctcaagaccactccgaagcagctgtccaagtcctggaatgaggagttgctgcaggatgtgtgtgctggcttggcagaggagctgcacctggcccccgacgcccctggtgggatggtggaattccggcgcaccctcaccctcagcttcttcttcaagttctacctgacagtgcttcagaagctgggcagagcggaccttgagggtatgtgtggtaaactggaccccacctttgccagcgccaccctgctctttcagaaggatcctccagctaacgtccagcttttccaagaggtgcccaagggtcagtctgaggaggacatggtgggcaggcccatgcctcacctggcagcagacatgcaggcatccggggaggctgtgtactgtgatgacattccccgctatgagaatgagctgtccctcaggctggtcaccagcacgcgggcccatgctaaaatcatgtccatcgacacttcagaagccaagaaggtgccagggtttgtttgtttcctcacctcagaggatgtccctggtagtaacataactggcattttcaatgatgaaactgtctttgcgaaggatgaggttacttgtgttgggcacatcattggtgctgtggtcgctgacaccccagaacatgcacacagagccgctagaggggtgaaaatcacctatgaagaccttccagccattatcacaatccaggatgctataaagaacaactccttttatggccccgaggtaaaaatcgagaaaggagatctcaagaaaggcttttctgaagctgacaatgttgtctcaggagaattatatattggtggccaggagcacttctatctggagacccactgcaccattgccgtgccgaaaggcgaggcaggcgagatggagctcttcgtgagcacacagaacaccatgaaaacccagagctttattgcaaagatgttgggtgttccagacaacagaattgtagtccgagtgaaaagaatgggtggaggctttggagggaaggagacccggagcactctgatatccacagcagtggccttggctgcatacaagacaggccgccctgtacgttgcatgctggaccgagacgaggacatgctcataactggtggcagacatcccttcctggctaaatacaaggtgggcttcatgaagactgggactatagtggcactggaggtggctcacttcagcaatggcgggaacagtgaggatctctctcggagtataatggaaagagctgtattccacatggacaacgcctataagatccccaacattcgcggcaccgggaggatttgtaagactaatctgccctctaacacagccttcagaggctttgggggtcctcaggggatgctaatcgcagaatactggatgagtgaggtcgctgtcacctgtgggctgcctgcagaggaggtacggaggaaaaacatgtacaaagaaggggacctgactcacttcaaccagaagctggaggggttcaccttgcccaggtgctgggatgagtgcatagcgagctcccagtatcaggctcgcaagatggaagtggagaaattcaacagggagaactgttggaaaaagagagggctgtgtataatcccgactaagtttggaataagcttcacactttcttttctgaaccaggggggtgccttggtccacgtgtacacggatgggtcggtgctgctgacacatggaggtactgagatgggtcaaggccttcacaccaagatggttcaggtggccagcagagctctgaaaatccccacttccaagatccatataacggagacaagcactaacactgtccctaacacctctcccacggctgcctctgccagcgctgacctcaatggccaggccatttatgaagcctgtcagaccatactgaaaagactggagcccttcaagaaaaagaatccctcaggctcctgggagagctgggtcatggatgcctacactagtgcagtgagcttgtctgctactggattttataagacacccaaccttggttacagctttgagacaaactctgggaaccccttccactacttcagttatggggtggcttgctcagaagtagaaattgactgcttaacaggggaccataagaatctccgtacagatatcgtcatggatgttggttccagcttgaatcctgccattgatatcggacaggtagaaggggcatttgtccagggtcttggtcttttcaccatggaggagctgcactactctcccgaggggagcctgcacactcgtggccccagtacctacaagatccctgcatttggcagcatccccattgagttcagagtatccctgctccgcgactgccccaacaagagggccatctatgcatccaaggctgtcggcgagccacctcttttcctggcttcttcgatcttctttgccatcaaagatgccatccgcgcagctcgagctcagcacggagacagtaacgccaaacagctcttccagctagacagccccgccactccggagaagatccgaaacgcttgtgtggatcagttcaccaccctgtgtgccactggaacaccagaaaactgtaaatcctggtccgtgaggatctgaaaaggaggctccccagtatggttttatactacagccctgattcctcggaatgtcaagtgcataccgtagtatccagatttccacacatcccatggggactcagcaggatggcattttcaagaaaatggacaattgtgatccaaatcatgagttgcaaacaaaccaataagcaaacggggagctgctggcccaagtggcagttttgagtaattctgggtaattctgagtccatttttgatcacatatttgaaatgaggttagcaagggtttgcattatgtccctactcgccacatggcctgtgtaactaagattctcacacacctcctgacgctgaaaccaacgtttctctagatctgcatgctttcttcagagagcttatatctgccaagccaccaagggccgtgttgtaaccgcagctgcacactcatagtcttcagtggaatagtgtgtgtgtgtgtgtgggggggggggattaaaacctccaactgcctttacatcatagaagacaataaaacatgataatgaatgtggggttaaaaaaaaaaa

SEQ ID NO: 4 - DNA, 4623 bp, Mus musculus
tttttttttttaaccccacattcattatcatgttttattgtcttctatgatgtaaaggcagttggaggttttaatcccccccccccacacacacacacacactattccactgaagactatgagtgtgcagctgcggttacaacacggcccttggtggcttggcagatataagctctctgaagaaagcatgcagatctagagaaacgttggtttcagcgtcaggaggtgtgtgagaatcttagttacacaggccatgtggcgagtagggacataatgcaaacccttgctaacctcatttcaaatatgtgatcaaaaatggactcagaattacccagaattactcaaaactgccacttgggccagcagctccccgtttgcttattggtttgtttgcaactcatgatttggatcacaattgtccattttcttgaaaatgccatcctgctgagtccccatgggatgtgtggaaatctggatactacggtatgcacttgacattccgaggaatcagggctgtagtataaaaccatactggggagcctccttttcagatcctcacggaccaggatttacagttttctggtgttccagtggcacacagggtggtgaactgatccacacaagcgtttcggatcttctccggagtggcggggctgtctagctggaagagctgtttggcgttactgtctccgtgctgagctcgagctgcgcggatggcatctttgatggcaaagaagatcgaagaagccaggaaaagaggtggctcgccgacagccttggatgcatagatggccctcttgttggggcagtcgcggagcagggatactctgaactcaatggggatgctgccaaatgcagggatcttgtaggtactggggccacgagtgtgcaggctcccctcgggagagtagtgcagctcctccatggtgaaaagaccaagaccctggacaaatgccccttctacctgtccgatatcaatggcaggattcaagctggaaccaacatccatgacgatatctgtacggagattcttatggtcccctgttaagcagtcaatttctacttctgagcaagccaccccataactgaagtagtggaaggggttcccagagtttgtctcaaagctgtaaccaaggttgggtgtcttataaaatccagtagcagacaagctcactgcactagtgtaggcatccatgacccagctctcccaggagcctgagggattctttttcttgaagggctccagtcttttcagtatggtctgacaggcttcataaatggcctggccattgaggtcagcgctggcagaggcagccgtgggagaggtgttagggacagtgttagtgcttgtctccgttatatggatcttggaagtggggattttcagagctctgctggccacctgaaccatcttggtgtgaaggccttgacccatctcagtacctccatgtgtcagcagcaccgacccatccgtgtacacgtggaccaaggcacccccctggttcagaaaagaaagtgtgaagcttattccaaacttagtcgggattatacacagccctctctttttccaacagttctccctgttgaatttctccacttccatcttgcgagcctgatactgggagctcgctatgcactcatcccagcacctgggcaaggtgaacccctccagcttctggttgaagtgagtcaggtccccttctttgtacatgtttttcctccgtacctcctctgcaggcagcccacaggtgacagcgacctcactcatccagtattctgcgattagcatcccctgaggacccccaaagcctctgaaggctgtgttagagggcagattagtcttacaaatcctcccggtgccgcgaatgttggggatcttataggcgttgtccatgtggaatacagctctttccattatactccgagagagatcctcactgttcccgccattgctgaagtgagccacctccagtgccactatagtcccagtcttcatgaagcccaccttgtatttagccaggaagggatgtctgccaccagttatgagcatgtcctcgtctcggtccagcatgcaacgtacagggcggcctgtcttgtatgcagccaaggccactgctgtggatatcagagtgctccgggtctccttccctccaaagcctccacccattcttttcactcggactacaattctgttgtctggaacacccaacatctttgcaataaagctctgggttttcatggtgttctgtgtgctcacgaagagctccatctcgcctgcctcgcctttcggcacggcaatggtgcagtgggtctccagatagaagtgctcctggccaccaatatataattctcctgagacaacattgtcagcttcagaaaagcctttcttgagatctcctttctcgatttttacctcggggccataaaaggagttgttctttatagcatcctggattgtgataatggctggaaggtcttcataggtgattttcacccctctagcggctctgtgtgcatgttctggggtgtcagcgaccacagcaccaatgatgtgcccaacacaagtaacctcatccttcgcaaagacagtttcatcattgaaaatgccagttatgttactaccagggacatcctctgaggtgaggaaacaaacaaaccctggcaccttcttggcttctgaagtgtcgatggacatgattttagcatgggcccgcgtgctggtgaccagcctgagggacagctcattctcatagcggggaatgtcatcacagtacacagcctccccggatgcctgcatgtctgctgccaggtgaggcatgggcctgcccaccatgtcctcctcagactgacccttgggcacctcttggaaaagctggacgttagctggaggatccttctgaaagagcagggtggcgctggcaaaggtggggtccagtttaccacacataccctcaaggtccgctctgcccagcttctgaagcactgtcaggtagaacttgaagaagaagctgagggtgagggtgcgccggaattccaccatcccaccaggggcgtcgggggccaggtgcagctcctctgccaagccagcacacacatcctgcagcaactcctcattccaggacttggacagctgcttcggagtggtcttgagggctgagacagttctgtcagccatccctccaaagcaaagggacagttcctgcacttcagtggtccctggcttgaacaggactctcatgccactggtcaccttggcaatgtcatcttctctcctggaggcctgcttgaaggctgagaaaaactcacccttcctgctgtaggggatcacaatggacaccaatatctcctctggactgagcagagtccttctatagccagggaagaaggtatggtccatccagaccgttctcttggtacctctagatgcgagggtcagcttggctcgactggccatgagcacagggttgaggtcagagatggggctcgcggtgatgatgttcccgccaatggacgccacggacttgacctgcttgccagcaaaccagcgcagctgctccatcacgcctctgaacacctctgtcctctgctctggaagtgtagcaatcgcgtccgccaggacactttccaccaagctaagggggcaagcggctccaaaggagattccctcaggcccatgtgccactgaggtcagttcaaggatccaggctgggcagatgatcagaggaaatagcatatttttaaatttcatttcaatgcctatctctgtgtttcccaccaccagcttggcatcagggtgctgggctttgaggtcaagcagttcctccatggttgaaacctggatccaggtcacacgttccccttcaaaacgcaacgtcttccggggagtgtctttcagcctcagcaactctgggggaaagatgggctcttgggtgggatctaaaggtttgaaatcctccgggttgaataaagaagatgagggagcaatcgtctggtcctttgtttggctcatgcagcagtttgggttgtttccacttcctccacagcacccaccatccttggcaaaggtccggaatccctggaggatgggtctatagcctgtacagcggcagaggtttccttggaaggcattctcgatctcctcgacagtaggctcaggcttgtttcggagcagtgtgtacatactcatgacaataccaggggtacagaacccacactgggaaccatggcttttggcaattctctcctggacaggatgcagcttcttggtgtttcctatgccttccacagttgtcacagcaacatgatgcaaggagcagatgggggtcaagcaggcattgacggaaaaatgaacgatcttgttctgaaggcggtcatacttggagatcatcacggtgcatgccccacagccaccttctccacagccaagcttggtcccgcacagccccaactttcttctaaggtagaccagaagtgttgtttcagggtctgcatttttctccaccacctttttgccattcacaaagaagaccaactcatctaccgttgtcctcgtcatcgtgacggccggagtccccgagctgctgcgaggtgcttgtagatatcactgcctgcaacttgaaagat

SEQ ID NO: 5 - DNA, 4198 bp, Rattus norvegicus
agagctcagtgactccagcagccacgatgactgcggatgagttggtcttctttgtgaatggcaaaaaggtggtggagaaaaatgcggaccctgaaacaacacttctggtctacctgagaagaaagttggggctatgtgggaccaagcttggctgtggagaaggtggctgtggggcatgcaccgtgatgatctccaagtatgaccgtcttcagaacaagattgttcatttttctgtcaatgcctgcttggctcccatctgctccttgcaccatgttgctgtgaccaccgtggaaggcataggaaacacccagaagctgcatcctgtacaggagagaattgccagaagccatggttcccagtgtgggttctgcactcctggcattgtcatgagtatgtacacactgctccggaaccagcctgagcctactgttgaggagatcgagaatgccttccaaggaaacctctgtcgctgtacaggctacagacccatcctccagggattccggacctttgccaaggatggtgggtgctgtggagggagtggaaacaacccaaactgctgtatgaaccagacgaaagaccaaacggtttctctctcaccttctttattcaacccagaggatttcaaacctttagatcccacgcaagagcccatcttccccccagagttgctgaggctgaaagacactccccagaagaagctgcgttttgaaggggaacgtgtgacctggatccaggcttcaactatggaggagctgcttgacctgaaagctcagcaccctgatgccaagctggtggtgggaaacacagagataggcattgaaatgaaatttaagaatatgctatttcctctgatcgtctgcccagcctggatccctgaactgaattcagtggtgcatgggcctgagggaatctccttcggagcttcttgcccccttagcttggtggaaagtgtcctggcggaggagattgctaaacttccagagcaaaagacagaggtgttcagaggcgtgatggagcagctgcgctggtttgccggcaagcaggtcaagtccgtggcgtccatcggagggaacatcatcactgccagccccatctctgacctcaaccctgtgttcatggccagtggagccaagctgactctggtgtctagaggtaccaggagaactgttcggatggatcataccttcttccctggctacagaaagactctgctcagaccagaggagatattgctgtccatcgagatcccctatagcaaggagggagagtttttctcagccttcaagcaggcctccaggagggaagatgacattgccaaggtgactagtggcatgagagtcctgttcaaaccggggaccattgaagtgcaggaactgtccctttgcttcggagggatggccgacagaactatctcagccctcaagaccactccgaagcagctatcgaagtcctggaatgaggagctgctgcagagcgtgtgtgccggcttggcagaggagctgcagctggcccccgatgcccctggtggtatggtggaattccggcgcaccctcaccctcagcttcttcttcaagttctacctgacagtgctccagaagctgggcagagcggaccttgaggatatgtgtggtaaactggaccccacctttgccagtgccaccctgctctttcagaaggaccctccagctaatgtccagcttttccaagaggtgccaaaggatcagtctgaggaggacatggtgggccggcccctgcctcacctggcggcaaacatgcaggcatcgggagaggccgtgtactgtgatgacattccccgctatgagaatgagctctctctcaggctggtcaccagcacccgggcgcatgctaaaatcacgtccatcgacacttcagaagccaagaaggtgccagggtttgtttgcttcctcaccgcagaggatgtccctaatagtaatgcaaccggccttttcaatgatgaaactgtctttgcgaaggatgaggttacttgtgttgggcacatcattggtgctgtggtcgctgacaccccagaacacgcacagagagctgcgagaggggtgaaaatcacctatgaagatcttccagccattatcacaatccaggatgctataaacaacaactccttttatggctctgagataaaaattgagaaaggagatctcaagaaaggcttttcagaagctgacaatgttgtctcaggagagttgtatatcggtggccaggagcacttctacctggagaccaactgcaccattgccgtgccaaaaggcgaggcaggcgagatggagctgttcgtgagcacacagaacaccatgaaaacccagagctttgttgcaaaaatgttgggcgttccggacaacagaatcgtagtccgagtgaagaggatgggtggaggctttggagggaaggagacccggagcactgtggtgtccacagcactggccttggctgcacacaagactggccggcccgtacgttgcatgttggaccgagatgaggacatgctgataactggtggcagacatcccttcctggctaaatacaaggttggcttcatgaagactgggactgtagtggctctcgaggtggctcacttcagcaatggtggtaacactgaggatctctctcggagtataatggaacgagctttgttccacatggataacgcctataagatccccaacattcgaggcactgggaggatttgcaagactaatctgccctccaacacagccttcagaggttttgggggtcctcaggggatgctaatcgcagaatactggatgagcgaggtcgccataacctgtgggctgcctgcagaggaggtacggaggaaaaacatgtacaaagaaggggacctgactcacttcaaccagaagctggaggggttcaccttgcccaggtgctgggatgaatgcatcgccagctctcagtatcttgctcgcaagagggaagtggagaaattcaacagggagaattgttggaaaaagagagggctgtgtataatcccaactaagtttggaataagctttacacttccttttctgaaccagggaggcgctctggttcacgtgtacactgatggttcggtgctgttgacccatggagggactgagatgggccaaggccttcacaccaagatggttcaggtggccagcagagctctgaaaatccccacctccaagattcatataagtgagacaagcactaacaccgtccccaacacttctcccacagctgcctctgccagtgctgacctcaatggacagggtgtttatgaagcatgccagaccatactgaaaaggctggaacctttcaagaagaagaaacccaccggcccctgggaggcatgggtgatggacgcctatacgagcgcagtgagtttgtccgcaactggattttataagacacccaaccttggctacagctttgagacaaactccggaaatcccttccactatttcagttatggggtggcttgctctgaagtagaaattgactgcttaacaggggatcataagaatctccgtacggatatcgtcatggatgttggttccagcttgaatcctgccattgatattggacaagtagagggggcatttgtccagggccttggtctcttcactatggaggagctgcactactcccctgaggggagcctgcatactcgtggccccagtacctacaaaatccctgcatttggtagcatccccattgagttcagagtatccctactccgggactgccccaacaagagggccatctatgcatccaaggctgttggggagccacctcttttcctggcttcctctatcttctttgccatcaaagatgccattcgtgcagctcgagctcagcacggagataacgcaaaacaacttttccagctagacagccctgccactccggagaagatccgaaacgcctgtgtggaccagttcaccaccctgtgtgtcactggagtaccagaaaactgtaaatcctggtctgtgaggatctgaagagaaggtctccaccattggtttgtaccgcaccaggattccttggagccacaagcacatcctgtagtatccagatttccgcatgccgcgtgggactcagcaggatgacattttcaggaagatggacattttgacccaaataagagctgcaaacaaaccaataagcaaatggggag

SEQ ID NO: 6 - DNA, 4198 bp, Rattus norvegicus
ctccccatttgcttattggtttgtttgcagctcttatttgggtcaaaatgtccatcttcctgaaaatgtcatcctgctgagtcccacgcggcatgcggaaatctggatactacaggatgtgcttgtggctccaaggaatcctggtgcggtacaaaccaatggtggagaccttctcttcagatcctcacagaccaggatttacagttttctggtactccagtgacacacagggtggtgaactggtccacacaggcgtttcggatcttctccggagtggcagggctgtctagctggaaaagttgttttgcgttatctccgtgctgagctcgagctgcacgaatggcatctttgatggcaaagaagatagaggaagccaggaaaagaggtggctccccaacagccttggatgcatagatggccctcttgttggggcagtcccggagtagggatactctgaactcaatggggatgctaccaaatgcagggattttgtaggtactggggccacgagtatgcaggctcccctcaggggagtagtgcagctcctccatagtgaagagaccaaggccctggacaaatgccccctctacttgtccaatatcaatggcaggattcaagctggaaccaacatccatgacgatatccgtacggagattcttatgatcccctgttaagcagtcaatttctacttcagagcaagccaccccataactgaaatagtggaagggatttccggagtttgtctcaaagctgtagccaaggttgggtgtcttataaaatccagttgcggacaaactcactgcgctcgtataggcgtccatcacccatgcctcccaggggccggtgggtttcttcttcttgaaaggttccagccttttcagtatggtctggcatgcttcataaacaccctgtccattgaggtcagcactggcagaggcagctgtgggagaagtgttggggacggtgttagtgcttgtctcacttatatgaatcttggaggtggggattttcagagctctgctggccacctgaaccatcttggtgtgaaggccttggcccatctcagtccctccatgggtcaacagcaccgaaccatcagtgtacacgtgaaccagagcgcctccctggttcagaaaaggaagtgtaaagcttattccaaacttagttgggattatacacagccctctctttttccaacaattctccctgttgaatttctccacttccctcttgcgagcaagatactgagagctggcgatgcattcatcccagcacctgggcaaggtgaacccctccagcttctggttgaagtgagtcaggtccccttctttgtacatgtttttcctccgtacctcctctgcaggcagcccacaggttatggcgacctcgctcatccagtattctgcgattagcatcccctgaggacccccaaaacctctgaaggctgtgttggagggcagattagtcttgcaaatcctcccagtgcctcgaatgttggggatcttataggcgttatccatgtggaacaaagctcgttccattatactccgagagagatcctcagtgttaccaccattgctgaagtgagccacctcgagagccactacagtcccagtcttcatgaagccaaccttgtatttagccaggaagggatgtctgccaccagttatcagcatgtcctcatctcggtccaacatgcaacgtacgggccggccagtcttgtgtgcagccaaggccagtgctgtggacaccacagtgctccgggtctccttccctccaaagcctccacccatcctcttcactcggactacgattctgttgtccggaacgcccaacatttttgcaacaaagctctgggttttcatggtgttctgtgtgctcacgaacagctccatctcgcctgcctcgccttttggcacggcaatggtgcagttggtctccaggtagaagtgctcctggccaccgatatacaactctcctgagacaacattgtcagcttctgaaaagcctttcttgagatctcctttctcaatttttatctcagagccataaaaggagttgttgtttatagcatcctggattgtgataatggctggaagatcttcataggtgattttcacccctctcgcagctctctgtgcgtgttctggggtgtcagcgaccacagcaccaatgatgtgcccaacacaagtaacctcatccttcgcaaagacagtttcatcattgaaaaggccggttgcattactattagggacatcctctgcggtgaggaagcaaacaaaccctggcaccttcttggcttctgaagtgtcgatggacgtgattttagcatgcgcccgggtgctggtgaccagcctgagagagagctcattctcatagcggggaatgtcatcacagtacacggcctctcccgatgcctgcatgtttgccgccaggtgaggcaggggccggcccaccatgtcctcctcagactgatcctttggcacctcttggaaaagctggacattagctggagggtccttctgaaagagcagggtggcactggcaaaggtggggtccagtttaccacacatatcctcaaggtccgctctgcccagcttctggagcactgtcaggtagaacttgaagaagaagctgagggtgagggtgcgccggaattccaccataccaccaggggcatcgggggccagctgcagctcctctgccaagccggcacacacgctctgcagcagctcctcattccaggacttcgatagctgcttcggagtggtcttgagggctgagatagttctgtcggccatccctccgaagcaaagggacagttcctgcacttcaatggtccccggtttgaacaggactctcatgccactagtcaccttggcaatgtcatcttccctcctggaggcctgcttgaaggctgagaaaaactctccctccttgctataggggatctcgatggacagcaatatctcctctggtctgagcagagtctttctgtagccagggaagaaggtatgatccatccgaacagttctcctggtacctctagacaccagagtcagcttggctccactggccatgaacacagggttgaggtcagagatggggctggcagtgatgatgttccctccgatggacgccacggacttgacctgcttgccggcaaaccagcgcagctgctccatcacgcctctgaacacctctgtcttttgctctggaagtttagcaatctcctccgccaggacactttccaccaagctaagggggcaagaagctccgaaggagattccctcaggcccatgcaccactgaattcagttcagggatccaggctgggcagacgatcagaggaaatagcatattcttaaatttcatttcaatgcctatctctgtgtttcccaccaccagcttggcatcagggtgctgagctttcaggtcaagcagctcctccatagttgaagcctggatccaggtcacacgttccccttcaaaacgcagcttcttctggggagtgtctttcagcctcagcaactctggggggaagatgggctcttgcgtgggatctaaaggtttgaaatcctctgggttgaataaagaaggtgagagagaaaccgtttggtctttcgtctggttcatacagcagtttgggttgtttccactccctccacagcacccaccatccttggcaaaggtccggaatccctggaggatgggtctgtagcctgtacagcgacagaggtttccttggaaggcattctcgatctcctcaacagtaggctcaggctggttccggagcagtgtgtacatactcatgacaatgccaggagtgcagaacccacactgggaaccatggcttctggcaattctctcctgtacaggatgcagcttctgggtgtttcctatgccttccacggtggtcacagcaacatggtgcaaggagcagatgggagccaagcaggcattgacagaaaaatgaacaatcttgttctgaagacggtcatacttggagatcatcacggtgcatgccccacagccaccttctccacagccaagcttggtcccacatagccccaactttcttctcaggtagaccagaagtgttgtttcagggtccgcatttttctccaccacctttttgccattcacaaagaagaccaactcatccgcagtcatcgtggctgctggagtcactgagctct

SEQ ID NO: 7 - DNA, 5694 bp, Macaca fascicularis
cattttattgggaggcataattttcaggttacagagcagtgataactacctgccagtgtctcttaggagtgaggtacctggagttgagggaccccaacctgtggcaatgacagcggacgagttggttttctttgtgaacggcagaaaggtggtggagaaaaatgcagatccagagacaacccttttggcctacctgagaagaaggttggggctgagtggaaccaagctcggctgtggagagggaggctgtggggcttgcacagtgatgctctccaagtatgatcgtctgcagaacaagatcgtccacttttctgccaatgcctgcctggcccccatctgctccttgcaccatgttgcagtgacaactgtggaaggaataggaagcaccaagacgaggctgcatcctgtgcaggagagaattgccaaaagccacggctcccagtgcgggttctgcacccccggcatcgtcatgagtatgtacacactgctccggaatcagcctgagcccaccatggaggagattgagaatgccttccaaggaaatctgtgccgctgcacaggctacagacccatcctccagggcttccggacctttgccaggggtggtggatgctgtgaaggagatgggaacaatccaaactgctgcatgagccagaagaaagaccactcggtcagtctctcaccatctttattcaagccagaggagttcacgcccctggatcccacccaggagcccatttttcccccagagttgctgaggttgaaagacactcctcggaagcagctgcgatttgaaggggagcgtgtgacgtggatacaggcctcaaccctcaaggagctgctggacctcaaggctcagtaccctgatgccaagctggtggtggggaacacggagattggcattgagatgaagttcaagaatatgctgtttcctatgatcgtctgcccagcttggatccctgagctgaattcagtagaacatggacccgagggtatctccttcggagctgcttgccccctgagcattgtggaaaagaccctggttgatgccattgctaagcttcctgcccaaaagacggaggtgttcagaggggtcctggagcagctgcgctggtttgctgggaagcaggtcaagtctgtggcgtccattggagggaacatcatcactgccagccccatctccgacctcaaccctgtgttcatggccagtggggccaagctgacacttgtgtccagaggcaccaggagaactgttccaatggaccacacattcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtagaggagctggccctttgctatggcggaatggccgacagaaccatctcggccctcaagaccactcagaggcagctttccaagctctggaccgaggagctgctgcaggacgtgtgtgcggccctggcggaggagctgcatctgcctcccgacgcccctggtggcatggtggacttccggcgcaccctcaccctcagcttcttcttcaagttctacctgacagtccttcggaagctgggccaagagaacccagaggacaaatgtggtaaactggaccccacgttcgccagtgcaactttactctttcagaaagacccgccagccaatgtccatctcttccaagaggtgcccaagggccagtctgaggaggacatggtgggccggcccctgccccacctggcagcgaacatgcaggcctctggtgaggccgtgtactgtgacgacatccctcgctatgagaatgagctgtctctccggctggtcaccagcacccgggcccacgccaagatcaagtccatagacatatcagaagccaagaaggtgccagggtttgtttgtttcatttccgctgatgatattcctgggagtaacataactggaatttgtaacgatgagacagtctttgcaaaggataaggttacttgtgttgggcatatcattggtgctgtggttgctgacaccccagaacacacacagagagctgcccaaggggtgaaaatcacctatgaagaactaccagccattatcacaattgaggatgctataaataacaactccttttatggacctgagctgaagatcgagaaaggggacctcaagaaggggttttccgaagcagataatgttgtgtcaggggagttatacatcggtggccaagagcacttctacctggagactcactgcaccattgctgttccaaaaggcgaggaaggagagatggagctctttgtgtctacacagaacaccatgaagacacagagctttgttgcaaaaatgttgggagttccagaaaaccggattgtggttcgagtgaagagaatcggaggaggctttggagggaaggagacccggagcactctggtgtccacggcggtggccctggccgcatataagactggccgccctgtgcgctgcatgctggaccgtgatgaggacatgctgataactggtggcagacatcccttcctggccagatacaaggttggcttcatgaagactgggaaggttgtggctctggaggtggatcacttcagcaacggggggaacacccaggatctctctcagagtattatggaacgagctctattccacatggacaactgctataaaattcccaacatccggggcactgggcggctgtgcaaaaccaaccttccctccaacacggccttccggggctttgggggtccccaggggatgctcattgccgagtattggatgagtgaagttgcggtgacctgtgggatgcctgcagaggaggtgcggatgaaaaacctgtacaaagaaggggacctgacacacttcaaccagaagcttgagagtttcaccttgcccaggtgctgggaagaatgcctagcaagctctcagtatcatgctcggaagagtgaggttgacaagttcaacaaggagaattgttggaaaaagagaggattgtacataattcccaccaagtttggaataagcttcacacttccttttctgaatcaggcaggagccctgcttcatgtgtacacagatggctctgtgctgctgacccatggagggaccgagatgggccaaggccttcataccaaaatggtccaggtggccagcagagctctgaaaatccccacctctaagatttatatcagtgagacaagcactaacactgtgcccaacacttctcccacggctgcctctgtcagcgctgacctcaatggacaagccgtctacgcggcttgtcagaccatcttgaaaaggctggaaccctacaagaagaagaatcccagtggctcctgggaagactgggtcacagctgcctacacggacacagtgagcttgtctgccactgggttttatagaacacccaatctgggctacagctttgagactaactcagggaaccctttccactacttcagctatggggtggcttgctctgaagtagaaattgactgcttaacaggagatcataagaacctccgcacagatattgtcatggatgttggctccagtctaaaccctgccattgatattggacaggtggaaggggcatttgtccagggccttggccttttcaccctagaggagctacactactcccccgaggggagcctgcacacccgcggccctagcacttacaagatcccggcatttggcagcatccccattgagttcagggtgtccctgctccgagactgccccaacaagaaggccatctatgcatcaaaggctgttggagagccacccctcttcctggctgcttctatcttctttgccatcaaagatgccatccgtgcagctcgagctcagcacacaggtaataacgtgaaggaactcttccggctagacagccctgccaccccggagaagatccgcaacgcctgcgtggacaggttcaccaccctgtgtgtcactggtgtaccagaaaactgcaaaccctggtctgtgagggtctgaagagagagtcctcagcagagtcttcctgtgctgcatttgggcttccatggagcaggaggaacataccacagaacatggatctattaaagtcacagaaggacagtgactaattctgtgacttttcatcctaattcatcaggatggcatttggaagacaagtgaatgcattgggagattttgattaaaatgtaatttataaacagaatgataagcaaattcaaaactgttaggcctaaatggtgaatatgcaattagggtcattttctgtctgttctaatcatgtatttggaatagggtcaggaagggtttgtgctattccccacttactggacagcctgtataacctcaagttctgatggtgtctgtccttcaaaagggactcccacaaacctctagaagcttaaaccaaagttactttaaattgtgtgccttcctctgaaagccttgccttcaaaccaatgaacagcaaagcataaccttgaatctatactcaaattttgcagtgaggcagtggggtaagattaaatcctctaaccatctttgaatcattggaaagaataaagaatgaaacaaattcaaggttaattgaatctaattttgttaagctgcataaagcaagattactctataacacaaaaatccaaccaactcaattattgagcacctacaatgttctagatttctttcccttcctctttgagtatttacaaaaaaagattatgtttaatctttacatttgaagccaaagtaatttccacctagaaatgatgctagcaggcctggcatggtggctcacgcctgtaatcccagcactttgggaggctgaggcaggagaattgcttgagcccagcagtttgagaccagcctgggcaacatagagagctcctgtcgtctggatagtgcatgcctgtagtctcaactactagaaaggctgaggtggagagatcatttgagttcaggaggttgagactgcagtgagctgtgactgcacccttgcactcctgcctgagctactgagcaagatcttgtctctgaagaaaaaaaaaagaaataaaaatgctgctgtcaaaatcaagctcaaccagaggtagaagagccaagaagcctgagttctcatcccagctctgtctcttctgtctctagctttgtgatcttggactgtcatttccccttcctgtgatccattttactgcagtaaaggttgtctcctgtcttctgctttaaaagtctataaatatatgacctgaaaactccagttacgtaagggatctgcagctatctaaggcttggttttcttactgtcatatgatacctgggcctgatgaactctgcttagatcccctcaagtttctgcggttggtaaagagaacaagggaagaacaagcatcccttttattgctctaagaggtgatttaatccctacatggtgctgagtggacagtgtgtcactgttgcatgccttcactctataaatccaaccttctgccagacagaatctgtggttctgtccatggagggaggataatggaaatgatatagttggactggtgcttgatgtcactaataaatgaaactgtcagcttgtt

SEQ ID NO: 8 - DNA, 5694 bp, Macaca fascicularis
aacaagctgacagtttcatttattagtgacatcaagcaccagtccaactatatcatttccattatcctccctccatggacagaaccacagattctgtctggcagaaggttggatttatagagtgaaggcatgcaacagtgacacactgtccactcagcaccatgtagggattaaatcacctcttagagcaataaaagggatgcttgttcttcccttgttctctttaccaaccgcagaaacttgaggggatctaagcagagttcatcaggcccaggtatcatatgacagtaagaaaaccaagccttagatagctgcagatcccttacgtaactggagttttcaggtcatatatttatagacttttaaagcagaagacaggagacaacctttactgcagtaaaatggatcacaggaaggggaaatgacagtccaagatcacaaagctagagacagaagagacagagctgggatgagaactcaggcttcttggctcttctacctctggttgagcttgattttgacagcagcatttttatttcttttttttttcttcagagacaagatcttgctcagtagctcaggcaggagtgcaagggtgcagtcacagctcactgcagtctcaacctcctgaactcaaatgatctctccacctcagcctttctagtagttgagactacaggcatgcactatccagacgacaggagctctctatgttgcccaggctggtctcaaactgctgggctcaagcaattctcctgcctcagcctcccaaagtgctgggattacaggcgtgagccaccatgccaggcctgctagcatcatttctaggtggaaattactttggcttcaaatgtaaagattaaacataatctttttttgtaaatactcaaagaggaagggaaagaaatctagaacattgtaggtgctcaataattgagttggttggatttttgtgttatagagtaatcttgctttatgcagcttaacaaaattagattcaattaaccttgaatttgtttcattctttattctttccaatgattcaaagatggttagaggatttaatcttaccccactgcctcactgcaaaatttgagtatagattcaaggttatgctttgctgttcattggtttgaaggcaaggctttcagaggaaggcacacaatttaaagtaactttggtttaagcttctagaggtttgtgggagtcccttttgaaggacagacaccatcagaacttgaggttatacaggctgtccagtaagtggggaatagcacaaacccttcctgaccctattccaaatacatgattagaacagacagaaaatgaccctaattgcatattcaccatttaggcctaacagttttgaatttgcttatcattctgtttataaattacattttaatcaaaatctcccaatgcattcacttgtcttccaaatgccatcctgatgaattaggatgaaaagtcacagaattagtcactgtccttctgtgactttaatagatccatgttctgtggtatgttcctcctgctccatggaagcccaaatgcagcacaggaagactctgctgaggactctctcttcagaccctcacagaccagggtttgcagttttctggtacaccagtgacacacagggtggtgaacctgtccacgcaggcgttgcggatcttctccggggtggcagggctgtctagccggaagagttccttcacgttattacctgtgtgctgagctcgagctgcacggatggcatctttgatggcaaagaagatagaagcagccaggaagaggggtggctctccaacagcctttgatgcatagatggccttcttgttggggcagtctcggagcagggacaccctgaactcaatggggatgctgccaaatgccgggatcttgtaagtgctagggccgcgggtgtgcaggctcccctcgggggagtagtgtagctcctctagggtgaaaaggccaaggccctggacaaatgccccttccacctgtccaatatcaatggcagggtttagactggagccaacatccatgacaatatctgtgcggaggttcttatgatctcctgttaagcagtcaatttctacttcagagcaagccaccccatagctgaagtagtggaaagggttccctgagttagtctcaaagctgtagcccagattgggtgttctataaaacccagtggcagacaagctcactgtgtccgtgtaggcagctgtgacccagtcttcccaggagccactgggattcttcttcttgtagggttccagccttttcaagatggtctgacaagccgcgtagacggcttgtccattgaggtcagcgctgacagaggcagccgtgggagaagtgttgggcacagtgttagtgcttgtctcactgatataaatcttagaggtggggattttcagagctctgctggccacctggaccattttggtatgaaggccttggcccatctcggtccctccatgggtcagcagcacagagccatctgtgtacacatgaagcagggctcctgcctgattcagaaaaggaagtgtgaagcttattccaaacttggtgggaattatgtacaatcctctctttttccaacaattctccttgttgaacttgtcaacctcactcttccgagcatgatactgagagcttgctaggcattcttcccagcacctgggcaaggtgaaactctcaagcttctggttgaagtgtgtcaggtccccttctttgtacaggtttttcatccgcacctcctctgcaggcatcccacaggtcaccgcaacttcactcatccaatactcggcaatgagcatcccctggggacccccaaagccccggaaggccgtgttggagggaaggttggttttgcacagccgcccagtgccccggatgttgggaattttatagcagttgtccatgtggaatagagctcgttccataatactctgagagagatcctgggtgttccccccgttgctgaagtgatccacctccagagccacaaccttcccagtcttcatgaagccaaccttgtatctggccaggaagggatgtctgccaccagttatcagcatgtcctcatcacggtccagcatgcagcgcacagggcggccagtcttatatgcggccagggccaccgccgtggacaccagagtgctccgggtctccttccctccaaagcctcctccgattctcttcactcgaaccacaatccggttttctggaactcccaacatttttgcaacaaagctctgtgtcttcatggtgttctgtgtagacacaaagagctccatctctccttcctcgccttttggaacagcaatggtgcagtgagtctccaggtagaagtgctcttggccaccgatgtataactcccctgacacaacattatctgcttcggaaaaccccttcttgaggtcccctttctcgatcttcagctcaggtccataaaaggagttgttatttatagcatcctcaattgtgataatggctggtagttcttcataggtgattttcaccccttgggcagctctctgtgtgtgttctggggtgtcagcaaccacagcaccaatgatatgcccaacacaagtaaccttatcctttgcaaagactgtctcatcgttacaaattccagttatgttactcccaggaatatcatcagcggaaatgaaacaaacaaaccctggcaccttcttggcttctgatatgtctatggacttgatcttggcgtgggcccgggtgctggtgaccagccggagagacagctcattctcatagcgagggatgtcgtcacagtacacggcctcaccagaggcctgcatgttcgctgccaggtggggcaggggccggcccaccatgtcctcctcagactggcccttgggcacctcttggaagagatggacattggctggcgggtctttctgaaagagtaaagttgcactggcgaacgtggggtccagtttaccacatttgtcctctgggttctcttggcccagcttccgaaggactgtcaggtagaacttgaagaagaagctgagggtgagggtgcgccggaagtccaccatgccaccaggggcgtcgggaggcagatgcagctcctccgccagggccgcacacacgtcctgcagcagctcctcggtccagagcttggaaagctgcctctgagtggtcttgagggccgagatggttctgtcggccattccgccatagcaaagggccagctcctctacctctgtggttcctggcttgaataaaactctcatgccactggttaccttggcaatgtcatcttctctccgggaggcctgcttgaatgctgagaaatactccccctccctgctgtaggggatctctatggagagcagtatctcctccgggctcagcagggtctttctgtagccagggaagaatgtgtggtccattggaacagttctcctggtgcctctggacacaagtgtcagcttggccccactggccatgaacacagggttgaggtcggagatggggctggcagtgatgatgttccctccaatggacgccacagacttgacctgcttcccagcaaaccagcgcagctgctccaggacccctctgaacacctccgtcttttgggcaggaagcttagcaatggcatcaaccagggtcttttccacaatgctcagggggcaagcagctccgaaggagataccctcgggtccatgttctactgaattcagctcagggatccaagctgggcagacgatcataggaaacagcatattcttgaacttcatctcaatgccaatctccgtgttccccaccaccagcttggcatcagggtactgagccttgaggtccagcagctccttgagggttgaggcctgtatccacgtcacacgctccccttcaaatcgcagctgcttccgaggagtgtctttcaacctcagcaactctgggggaaaaatgggctcctgggtgggatccaggggcgtgaactcctctggcttgaataaagatggtgagagactgaccgagtggtctttcttctggctcatgcagcagtttggattgttcccatctccttcacagcatccaccacccctggcaaaggtccggaagccctggaggatgggtctgtagcctgtgcagcggcacagatttccttggaaggcattctcaatctcctccatggtgggctcaggctgattccggagcagtgtgtacatactcatgacgatgccgggggtgcagaacccgcactgggagccgtggcttttggcaattctctcctgcacaggatgcagcctcgtcttggtgcttcctattccttccacagttgtcactgcaacatggtgcaaggagcagatgggggccaggcaggcattggcagaaaagtggacgatcttgttctgcagacgatcatacttggagagcatcactgtgcaagccccacagcctccctctccacagccgagcttggttccactcagccccaaccttcttctcaggtaggccaaaagggttgtctctggatctgcatttttctccaccacctttctgccgttcacaaagaaaaccaactcgtccgctgtcattgccacaggttggggtccctcaactccaggtacctcactcctaagagacactggcaggtagttatcactgctctgtaacctgaaaattatgcctcccaataaaatg

SEQ ID NO: 9 - DNA, 3511 bp, Homo sapiens
tcaggtcacagagcagtgataactacctgccagtgtctcttaggagtgaggtacctggagttcggggaccccaacctgtgacaatgacagcagacaaattggttttctttgtgaatggcagaaaggtggtggagaaaaatgcagatccagagacaacccttttggcctacctgagaagaaagttggggctgagtggaaccaagctcggctgtggagaggggggctgcggggcttgcacagtgatgctctccaagtatgatcgtctgcagaacaagatcgtccacttttctgccaatgcctgcctggcccccatctgctccttgcaccatgttgcagtgacaactgtggaaggaataggaagcaccaagacgaggctgcatcctgtgcaggagagaattgccaaaagccacggctcccagtgcgggttctgcacccctggcatcgtcatgagtatgtacacactgctccggaatcagcccgagcccaccatggaggagattgagaatgccttccaaggaaatctgtgccgctgcacaggctacagacccatcctccagggcttccggacctttgccagggatggtggatgctgtggaggagatgggaataatccaaattgctgcatgaaccagaagaaagaccactcagtcagcctctcgccatctttattcaaaccagaggagttcacgcccctggatccaacccaggagcccatttttcccccagagttgctgaggctgaaagacactcctcggaagcagctgcgatttgaaggggagcgtgtgacgtggatacaggcctcaaccctcaaggagctgctggacctcaaggctcagcaccctgacgccaagctggtcgtggggaacacggagattggcattgagatgaagttcaagaatatgctgtttcctatgattgtctgcccagcctggatccctgagctgaattcggtagaacatggacccgacggtatctcctttggagctgcttgccccctgagcattgtggaaaaaaccctggtggatgctgttgctaagcttcctgcccaaaagacagaggtgttcagaggggtcctggagcagctgcgctggtttgctgggaagcaagtcaagtctgtggcgtccgttggagggaacatcatcactgccagccccatctccgacctcaaccccgtgttcatggccagtggggccaagctgacacttgtgtccagaggcaccaggagaactgtccagatggaccacaccttcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtacaggagctggccctttgctatggtggaatggccaacagaaccatctcagccctcaagaccactcagaggcagctttccaagctctggaaggaggagctgctgcaggacgtgtgtgcaggactggcagaggagctgcatctgcctcccgatgcccctggtggcatggtggacttccggtgcaccctcaccctcagcttcttcttcaagttctacctgacagtccttcagaagctgggccaagagaacctggaagacaagtgtggtaaactggaccccactttcgccagtgcaactttactgtttcagaaagaccccccagccgatgtccagctcttccaagaggtgcccaagggtcagtctgaggaggacatggtgggccggcccctgccccacctggcagcggacatgcaggcctctggtgaggccgtgtactgtgacgacattcctcgctacgagaatgagctgtctctccggctggtcaccagcacccgggcccacgccaagatcaagtccatagatacatcagaagctaagaaggttccagggtttgtttgtttcatttccgctgatgatgttcctgggagtaacataactggaatttgtaatgatgagacagtctttgcgaaggataaggttacttgtgttgggcatatcattggtgctgtggttgctgacaccccggaacacacacagagagctgcccaaggggtgaaaatcacctatgaagaactaccagccattatcacaattgaggatgctataaagaacaactccttttatggacctgagctgaagatcgagaaaggggacctaaagaaggggttttccgaagcagataatgttgtgtcaggggagatatacatcggtggccaagagcacttctacctggagactcactgcaccattgctgttccaaaaggcgaggcaggggagatggagctctttgtgtctacacagaacaccatgaagacccagagctttgttgcaaaaatgttgggggttccagcaaaccggattgtggttcgagtgaagagaatgggaggaggctttggaggcaaggagacccggagcactgtggtgtccacggcagtggccctggctgcatataagaccggccgccctgtgcgatgcatgctggaccgtgatgaggacatgctgataactggtggcagacatcccttcctggccagatacaaggttggcttcatgaagactgggacagttgtggctcttgaggtggaccacttcagcaatgtggggaacacccaggatctctctcagagtattatggaacgagctttattccacatggacaactgctataaaatccccaacatccggggcactgggcggctgtgcaaaaccaaccttccctccaacacggccttccggggctttggggggccccaggggatgctcattgccgagtgctggatgagtgaagttgcagtgacctgtgggatgcctgcagaggaggtgcggagaaaaaacctgtacaaagaaggggacctgacacacttcaaccagaagcttgagggtttcaccttgcccagatgctgggaagaatgcctagcaagctctcagtatcatgctcggaagagtgaggttgacaagttcaacaaggagaattgttggaaaaagagaggattgtgcataattcccaccaagtttggaataagctttacagttccttttctgaatcaggcaggagccctacttcatgtgtacacagatggctctgtgctgctgacccacggggggactgagatgggccaaggccttcataccaaaatggtccaggagttggccaggtgacctctgaggacattgctattaccaacattctcagtgtgtgaggcgggcatgctctgtgtgtaaaggtcgcgagtttcccacattccaagactcctcggagtggagtgaggacaatgagctggattagagtcagcacatctgcttggcgcatggagactggccagattggatcttttgaaaagtgagtgttagtgtaaaaaggcactgtttgtcagtttatgaattttttatccaaccgaactccaccaagtgctccttcaaattca

SEQ ID NO: 10 - DNA, 3511 bp, Homo sapiens
tgaatttgaaggagcacttggtggagttcggttggataaaaaattcataaactgacaaacagtgcctttttacactaacactcacttttcaaaagatccaatctggccagtctccatgcgccaagcagatgtgctgactctaatccagctcattgtcctcactccactccgaggagtcttggaatgtgggaaactcgcgacctttacacacagagcatgcccgcctcacacactgagaatgttggtaatagcaatgtcctcagaggtcacctggccaactcctggaccattttggtatgaaggccttggcccatctcagtccccccgtgggtcagcagcacagagccatctgtgtacacatgaagtagggctcctgcctgattcagaaaaggaactgtaaagcttattccaaacttggtgggaattatgcacaatcctctctttttccaacaattctccttgttgaacttgtcaacctcactcttccgagcatgatactgagagcttgctaggcattcttcccagcatctgggcaaggtgaaaccctcaagcttctggttgaagtgtgtcaggtccccttctttgtacaggttttttctccgcacctcctctgcaggcatcccacaggtcactgcaacttcactcatccagcactcggcaatgagcatcccctggggccccccaaagccccggaaggccgtgttggagggaaggttggttttgcacagccgcccagtgccccggatgttggggattttatagcagttgtccatgtggaataaagctcgttccataatactctgagagagatcctgggtgttccccacattgctgaagtggtccacctcaagagccacaactgtcccagtcttcatgaagccaaccttgtatctggccaggaagggatgtctgccaccagttatcagcatgtcctcatcacggtccagcatgcatcgcacagggcggccggtcttatatgcagccagggccactgccgtggacaccacagtgctccgggtctccttgcctccaaagcctcctcccattctcttcactcgaaccacaatccggtttgctggaacccccaacatttttgcaacaaagctctgggtcttcatggtgttctgtgtagacacaaagagctccatctcccctgcctcgccttttggaacagcaatggtgcagtgagtctccaggtagaagtgctcttggccaccgatgtatatctcccctgacacaacattatctgcttcggaaaaccccttctttaggtcccctttctcgatcttcagctcaggtccataaaaggagttgttctttatagcatcctcaattgtgataatggctggtagttcttcataggtgattttcaccccttgggcagctctctgtgtgtgttccggggtgtcagcaaccacagcaccaatgatatgcccaacacaagtaaccttatccttcgcaaagactgtctcatcattacaaattccagttatgttactcccaggaacatcatcagcggaaatgaaacaaacaaaccctggaaccttcttagcttctgatgtatctatggacttgatcttggcgtgggcccgggtgctggtgaccagccggagagacagctcattctcgtagcgaggaatgtcgtcacagtacacggcctcaccagaggcctgcatgtccgctgccaggtggggcaggggccggcccaccatgtcctcctcagactgacccttgggcacctcttggaagagctggacatcggctggggggtctttctgaaacagtaaagttgcactggcgaaagtggggtccagtttaccacacttgtcttccaggttctcttggcccagcttctgaaggactgtcaggtagaacttgaagaagaagctgagggtgagggtgcaccggaagtccaccatgccaccaggggcatcgggaggcagatgcagctcctctgccagtcctgcacacacgtcctgcagcagctcctccttccagagcttggaaagctgcctctgagtggtcttgagggctgagatggttctgttggccattccaccatagcaaagggccagctcctgtacctctgtggttcctggcttgaataaaactctcatgccactggttaccttggcaatgtcatcttctctccgggaggcctgcttgaatgctgagaaatactccccctccctgctgtaggggatctctatggagagcagtatctcctccgggctcagcagggtctttctgtagccagggaagaaggtgtggtccatctggacagttctcctggtgcctctggacacaagtgtcagcttggccccactggccatgaacacggggttgaggtcggagatggggctggcagtgatgatgttccctccaacggacgccacagacttgacttgcttcccagcaaaccagcgcagctgctccaggacccctctgaacacctctgtcttttgggcaggaagcttagcaacagcatccaccagggttttttccacaatgctcagggggcaagcagctccaaaggagataccgtcgggtccatgttctaccgaattcagctcagggatccaggctgggcagacaatcataggaaacagcatattcttgaacttcatctcaatgccaatctccgtgttccccacgaccagcttggcgtcagggtgctgagccttgaggtccagcagctccttgagggttgaggcctgtatccacgtcacacgctccccttcaaatcgcagctgcttccgaggagtgtctttcagcctcagcaactctgggggaaaaatgggctcctgggttggatccaggggcgtgaactcctctggtttgaataaagatggcgagaggctgactgagtggtctttcttctggttcatgcagcaatttggattattcccatctcctccacagcatccaccatccctggcaaaggtccggaagccctggaggatgggtctgtagcctgtgcagcggcacagatttccttggaaggcattctcaatctcctccatggtgggctcgggctgattccggagcagtgtgtacatactcatgacgatgccaggggtgcagaacccgcactgggagccgtggcttttggcaattctctcctgcacaggatgcagcctcgtcttggtgcttcctattccttccacagttgtcactgcaacatggtgcaaggagcagatgggggccaggcaggcattggcagaaaagtggacgatcttgttctgcagacgatcatacttggagagcatcactgtgcaagccccgcagcccccctctccacagccgagcttggttccactcagccccaactttcttctcaggtaggccaaaagggttgtctctggatctgcatttttctccaccacctttctgccattcacaaagaaaaccaatttgtctgctgtcattgtcacaggttggggtccccgaactccaggtacctcactcctaagagacactggcaggtagttatcactgctctgtgacctga

SEQ ID NO: 11 - protein, 16 aa, Unknown
  Description of Unknown: RFGF peptide
AAVALLPAVLLALLAP

SEQ ID NO: 12 - protein, 11 aa, Unknown
  Description of Unknown: RFGF analogue peptide
AALLPVLLAAP

SEQ ID NO: 13 - protein, 13 aa, Human immunodeficiency virus
GRKKRRQRRRPPQ

SEQ ID NO: 14 - protein, 16 aa, Drosophila sp.
RQIKIWFQNRRMKWKK

SEQ ID NO: 15 - DNA, 5691 bp, Macaca fascicularis
cattttattgggaggcataattttcaggttacagagcagtgataactacctgccagtgtctcttaggagtgaggtacctggagttgagggaccccaacctgtggcaatgacagcggacgagttggttttctttgtgaacggcagaaaggtggtggagaaaaatgcagatccagagacaacccttttggcctacctgagaagaaggttggggctgagtggaaccaagctcggctgtggagagggaggctgtggggcttgcacagtgatgctctccaagtatgatcgtctgcagaacaagatcgtccacttttctgccaatgcctgcctggcccccatctgctccttgcaccatgttgcagtgacaactgtggaaggaataggaagcaccaagacgaggctgcatcctgtgcaggagagaattgccaaaagccacggctcccagtgcgggttctgcacccccggcatcgtcatgagtatgtacacactgctccggaatcagcctgagcccaccatggaggagattgagaatgccttccaaggaaatctgtgccgctgcacaggctacagacccatcctccagggcttccggacctttgccaggggtggtggatgctgtgaaggagatgggaacaatccaaactgctgcatgagccagaagaaagaccactcggtcagtctctcaccatctttattcaagccagaggagttcacgcccctggatcccacccaggagcccatttttcccccagagttgctgaggttgaaagacactcctcggaagcagctgcgatttgaaggggagcgtgtgacgtggatacaggcctcaaccctcaaggagctgctggacctcaaggctcagtaccctgatgccaagctggtggtggggaacacggagattggcattgagatgaagttcaagaatatgctgtttcctatgatcgtctgcccagcttggatccctgagctgaattcagtagaacatggacccgagggtatctccttcggagctgcttgccccctgagcattgtggaaaagaccctggttgatgccattgctaagcttcctgcccaaaagacggaggtgttcagaggggtcctggagcagctgcgctggtttgctgggaagcaggtcaagtctgtggcgtccattggagggaacatcatcactgccagccccatctccgacctcaaccctgtgttcatggccagtggggccaagctgacacttgtgtccagaggcaccaggagaactgttccaatggaccacacattcttccctggctacagaaagaccctgctgagcccggaggagatactgctctccatagagatcccctacagcagggagggggagtatttctcagcattcaagcaggcctcccggagagaagatgacattgccaaggtaaccagtggcatgagagttttattcaagccaggaaccacagaggtagaggagctggccctttgctatggcggaatggccgacagaaccatctcggccctcaagaccactcagaggcagctttccaagctctggaccgaggagctgctgcaggacgtgtgtgcggccctggcggaggagctgcatctgcctcccgacgcccctggtggcatggtggacttccggcgcaccctcaccctcagcttcttcttcaagttctacctgacagtccttcggaagctgggccaagagaacccagaggactgtggtaaactggaccccacgttcgccagtgcaactttactctttcagaaagacccgccagccaatgtccatctcttccaagaggtgcccaagggccagtctgaggaggacatggtgggccggcccctgccccacctggcagcgaacatgcaggcctctggtgaggccgtgtactgtgacgacatccctcgctatgagaatgagctgtctctccggctggtcaccagcacccgggcccacgccaagatcaagtccatagacatatcagaagccaagaaggtgccagggtttgtttgtttcatttccgctgatgatattcctgggagtaacataactggaatttgtaacgatgagacagtctttgcaaaggataaggttacttgtgttgggcatatcattggtgctgtggttgctgacaccccagaacacacacagagagctgcccaaggggtgaaaatcacctatgaagaactaccagccattatcacaattgaggatgctataaataacaactccttttatggacctgagctgaagatcgagaaaggggacctcaagaaggggttttccgaagcagataatgttgtgtcaggggagttatacatcggtggccaagagcacttctacctggagactcactgcaccattgctgttccaaaaggcgaggaaggagagatggagctctttgtgtctacacagaacaccatgaagacacagagctttgttgcaaaaatgttgggagttccagaaaaccggattgtggttcgagtgaagagaatcggaggaggctttggagggaaggagacccggagcactctggtgtccacggcggtggccctggccgcatataagactggccgccctgtgcgctgcatgctggaccgtgatgaggacatgctgataactggtggcagacatcccttcctggccagatacaaggttggcttcatgaagactgggaaggttgtggctctggaggtggatcacttcagcaacggggggaacacccaggatctctctcagagtattatggaacgagctctattccacatggacaactgctataaaattcccaacatccggggcactgggcggctgtgcaaaaccaaccttccctccaacacggccttccggggctttgggggtccccaggggatgctcattgccgagtattggatgagtgaagttgcggtgacctgtgggatgcctgcagaggaggtgcggatgaaaaacctgtacaaagaaggggacctgacacacttcaaccagaagcttgagagtttcaccttgcccaggtgctgggaagaatgcctagcaagctctcagtatcatgctcggaagagtgaggttgacaagttcaacaaggagaattgttggaaaaagagaggattgtacataattcccaccaagtttggaataagcttcacacttccttttctgaatcaggcaggagccctgcttcatgtgtacacagatggctctgtgctgctgacccatggagggaccgagatgggccaaggccttcataccaaaatggtccaggtggccagcagagctctgaaaatccccacctctaagatttatatcagtgagacaagcactaacactgtgcccaacacttctcccacggctgcctctgtcagcgctgacctcaatggacaagccgtctacgcggcttgtcagaccatcttgaaaaggctggaaccctacaagaagaagaatcccagtggctcctgggaagactgggtcacagctgcctacacggacacagtgagcttgtctgccactgggttttatagaacacccaatctgggctacagctttgagactaactcagggaaccctttccactacttcagctatggggtggcttgctctgaagtagaaattgactgcttaacaggagatcataagaacctccgcacagatattgtcatggatgttggctccagtctaaaccctgccattgatattggacaggtggaaggggcatttgtccagggccttggccttttcaccctagaggagctacactactcccccgaggggagcctgcacacccgcggccctagcacttacaagatcccggcatttggcagcatccccattgagttcagggtgtccctgctccgagactgccccaacaagaaggccatctatgcatcaaaggctgttggagagccacccctcttcctggctgcttctatcttctttgccatcaaagatgccatccgtgcagctcgagctcagcacacaggtaataacgtgaaggaactcttccggctagacagccctgccaccccggagaagatccgcaacgcctgcgtggacaggttcaccaccctgtgtgtcactggtgtaccagaaaactgcaaaccctggtctgtgagggtctgaagagagagtcctcagcagagtcttcctgtgctgcatttgggcttccatggagcaggaggaacataccacagaacatggatctattaaagtcacagaaggacagtgactaattctgtgacttttcatcctaattcatcaggatggcatttggaagacaagtgaatgcattgggagattttgattaaaatgtaatttataaacagaatgataagcaaattcaaaactgttaggcctaaatggtgaatatgcaattagggtcattttctgtctgttctaatcatgtatttggaatagggtcaggaagggtttgtgctattccccacttactggacagcctgtataacctcaagttctgatggtgtctgtccttcaaaagggactcccacaaacctctagaagcttaaaccaaagttactttaaattgtgtgccttcctctgaaagccttgccttcaaaccaatgaacagcaaagcataaccttgaatctatactcaaattttgcagtgaggcagtggggtaagattaaatcctctaaccatctttgaatcattggaaagaataaagaatgaaacaaattcaaggttaattgaatctaattttgttaagctgcataaagcaagattactctataacacaaaaatccaaccaactcaattattgagcacctacaatgttctagatttctttcccttcctctttgagtatttacaaaaaaagattatgtttaatctttacatttgaagccaaagtaatttccacctagaaatgatgctagcaggcctggcatggtggctcacgcctgtaatcccagcactttgggaggctgaggcaggagaattgcttgagcccagcagtttgagaccagcctgggcaacatagagagctcctgtcgtctggatagtgcatgcctgtagtctcaactactagaaaggctgaggtggagagatcatttgagttcaggaggttgagactgcagtgagctgtgactgcacccttgcactcctgcctgagctactgagcaagatcttgtctctgaagaaaaaaaaaagaaataaaaatgctgctgtcaaaatcaagctcaaccagaggtagaagagccaagaagcctgagttctcatcccagctctgtctcttctgtctctagctttgtgatcttggactgtcatttccccttcctgtgatccattttactgcagtaaaggttgtctcctgtcttctgctttaaaagtctataaatatatgacctgaaaactccagttacgtaagggatctgcagctatctaaggcttggttttcttactgtcatatgatacctgggcctgatgaactctgcttagatcccctcaagtttctgcggttggtaaagagaacaagggaagaacaagcatcccttttattgctctaagaggtgatttaatccctacatggtgctgagtggacagtgtgtcactgttgcatgccttcactctataaatccaaccttctgccagacagaatctgtggttctgtccatggagggaggataatggaaatgatatagttggactggtgcttgatgtcactaataaatgaaactgtcagcttgtt

SEQ ID NO: 16 - DNA, 5691 bp, Macaca fascicularis
aacaagctgacagtttcatttattagtgacatcaagcaccagtccaactatatcatttccattatcctccctccatggacagaaccacagattctgtctggcagaaggttggatttatagagtgaaggcatgcaacagtgacacactgtccactcagcaccatgtagggattaaatcacctcttagagcaataaaagggatgcttgttcttcccttgttctctttaccaaccgcagaaacttgaggggatctaagcagagttcatcaggcccaggtatcatatgacagtaagaaaaccaagccttagatagctgcagatcccttacgtaactggagttttcaggtcatatatttatagacttttaaagcagaagacaggagacaacctttactgcagtaaaatggatcacaggaaggggaaatgacagtccaagatcacaaagctagagacagaagagacagagctgggatgagaactcaggcttcttggctcttctacctctggttgagcttgattttgacagcagcatttttatttcttttttttttcttcagagacaagatcttgctcagtagctcaggcaggagtgcaagggtgcagtcacagctcactgcagtctcaacctcctgaactcaaatgatctctccacctcagcctttctagtagttgagactacaggcatgcactatccagacgacaggagctctctatgttgcccaggctggtctcaaactgctgggctcaagcaattctcctgcctcagcctcccaaagtgctgggattacaggcgtgagccaccatgccaggcctgctagcatcatttctaggtggaaattactttggcttcaaatgtaaagattaaacataatctttttttgtaaatactcaaagaggaagggaaagaaatctagaacattgtaggtgctcaataattgagttggttggatttttgtgttatagagtaatcttgctttatgcagcttaacaaaattagattcaattaaccttgaatttgtttcattctttattctttccaatgattcaaagatggttagaggatttaatcttaccccactgcctcactgcaaaatttgagtatagattcaaggttatgctttgctgttcattggtttgaaggcaaggctttcagaggaaggcacacaatttaaagtaactttggtttaagcttctagaggtttgtgggagtcccttttgaaggacagacaccatcagaacttgaggttatacaggctgtccagtaagtggggaatagcacaaacccttcctgaccctattccaaatacatgattagaacagacagaaaatgaccctaattgcatattcaccatttaggcctaacagttttgaatttgcttatcattctgtttataaattacattttaatcaaaatctcccaatgcattcacttgtcttccaaatgccatcctgatgaattaggatgaaaagtcacagaattagtcactgtccttctgtgactttaatagatccatgttctgtggtatgttcctcctgctccatggaagcccaaatgcagcacaggaagactctgctgaggactctctcttcagaccctcacagaccagggtttgcagttttctggtacaccagtgacacacagggtggtgaacctgtccacgcaggcgttgcggatcttctccggggtggcagggctgtctagccggaagagttccttcacgttattacctgtgtgctgagctcgagctgcacggatggcatctttgatggcaaagaagatagaagcagccaggaagaggggtggctctccaacagcctttgatgcatagatggccttcttgttggggcagtctcggagcagggacaccctgaactcaatggggatgctgccaaatgccgggatcttgtaagtgctagggccgcgggtgtgcaggctcccctcgggggagtagtgtagctcctctagggtgaaaaggccaaggccctggacaaatgccccttccacctgtccaatatcaatggcagggtttagactggagccaacatccatgacaatatctgtgcggaggttcttatgatctcctgttaagcagtcaatttctacttcagagcaagccaccccatagctgaagtagtggaaagggttccctgagttagtctcaaagctgtagcccagattgggtgttctataaaacccagtggcagacaagctcactgtgtccgtgtaggcagctgtgacccagtcttcccaggagccactgggattcttcttcttgtagggttccagccttttcaagatggtctgacaagccgcgtagacggcttgtccattgaggtcagcgctgacagaggcagccgtgggagaagtgttgggcacagtgttagtgcttgtctcactgatataaatcttagaggtggggattttcagagctctgctggccacctggaccattttggtatgaaggccttggcccatctcggtccctccatgggtcagcagcacagagccatctgtgtacacatgaagcagggctcctgcctgattcagaaaaggaagtgtgaagcttattccaaacttggtgggaattatgtacaatcctctctttttccaacaattctccttgttgaacttgtcaacctcactcttccgagcatgatactgagagcttgctaggcattcttcccagcacctgggcaaggtgaaactctcaagcttctggttgaagtgtgtcaggtccccttctttgtacaggtttttcatccgcacctcctctgcaggcatcccacaggtcaccgcaacttcactcatccaatactcggcaatgagcatcccctggggacccccaaagccccggaaggccgtgttggagggaaggttggttttgcacagccgcccagtgccccggatgttgggaattttatagcagttgtccatgtggaatagagctcgttccataatactctgagagagatcctgggtgttccccccgttgctgaagtgatccacctccagagccacaaccttcccagtcttcatgaagccaaccttgtatctggccaggaagggatgtctgccaccagttatcagcatgtcctcatcacggtccagcatgcagcgcacagggcggccagtcttatatgcggccagggccaccgccgtggacaccagagtgctccgggtctccttccctccaaagcctcctccgattctcttcactcgaaccacaatccggttttctggaactcccaacatttttgcaacaaagctctgtgtcttcatggtgttctgtgtagacacaaagagctccatctctccttcctcgccttttggaacagcaatggtgcagtgagtctccaggtagaagtgctcttggccaccgatgtataactcccctgacacaacattatctgcttcggaaaaccccttcttgaggtcccctttctcgatcttcagctcaggtccataaaaggagttgttatttatagcatcctcaattgtgataatggctggtagttcttcataggtgattttcaccccttgggcagctctctgtgtgtgttctggggtgtcagcaaccacagcaccaatgatatgcccaacacaagtaaccttatcctttgcaaagactgtctcatcgttacaaattccagttatgttactcccaggaatatcatcagcggaaatgaaacaaacaaaccctggcaccttcttggcttctgatatgtctatggacttgatcttggcgtgggcccgggtgctggtgaccagccggagagacagctcattctcatagcgagggatgtcgtcacagtacacggcctcaccagaggcctgcatgttcgctgccaggtggggcaggggccggcccaccatgtcctcctcagactggcccttgggcacctcttggaagagatggacattggctggcgggtctttctgaaagagtaaagttgcactggcgaacgtggggtccagtttaccacagtcctctgggttctcttggcccagcttccgaaggactgtcaggtagaacttgaagaagaagctgagggtgagggtgcgccggaagtccaccatgccaccaggggcgtcgggaggcagatgcagctcctccgccagggccgcacacacgtcctgcagcagctcctcggtccagagcttggaaagctgcctctgagtggtcttgagggccgagatggttctgtcggccattccgccatagcaaagggccagctcctctacctctgtggttcctggcttgaataaaactctcatgccactggttaccttggcaatgtcatcttctctccgggaggcctgcttgaatgctgagaaatactccccctccctgctgtaggggatctctatggagagcagtatctcctccgggctcagcagggtctttctgtagccagggaagaatgtgtggtccattggaacagttctcctggtgcctctggacacaagtgtcagcttggccccactggccatgaacacagggttgaggtcggagatggggctggcagtgatgatgttccctccaatggacgccacagacttgacctgcttcccagcaaaccagcgcagctgctccaggacccctctgaacacctccgtcttttgggcaggaagcttagcaatggcatcaaccagggtcttttccacaatgctcagggggcaagcagctccgaaggagataccctcgggtccatgttctactgaattcagctcagggatccaagctgggcagacgatcataggaaacagcatattcttgaacttcatctcaatgccaatctccgtgttccccaccaccagcttggcatcagggtactgagccttgaggtccagcagctccttgagggttgaggcctgtatccacgtcacacgctccccttcaaatcgcagctgcttccgaggagtgtctttcaacctcagcaactctgggggaaaaatgggctcctgggtgggatccaggggcgtgaactcctctggcttgaataaagatggtgagagactgaccgagtggtctttcttctggctcatgcagcagtttggattgttcccatctccttcacagcatccaccacccctggcaaaggtccggaagccctggaggatgggtctgtagcctgtgcagcggcacagatttccttggaaggcattctcaatctcctccatggtgggctcaggctgattccggagcagtgtgtacatactcatgacgatgccgggggtgcagaacccgcactgggagccgtggcttttggcaattctctcctgcacaggatgcagcctcgtcttggtgcttcctattccttccacagttgtcactgcaacatggtgcaaggagcagatgggggccaggcaggcattggcagaaaagtggacgatcttgttctgcagacgatcatacttggagagcatcactgtgcaagccccacagcctccctctccacagccgagcttggttccactcagccccaaccttcttctcaggtaggccaaaagggttgtctctggatctgcatttttctccaccacctttctgccgttcacaaagaaaaccaactcgtccgctgtcattgccacaggttggggtccctcaactccaggtacctcactcctaagagacactggcaggtagttatcactgctctgtaacctgaaaattatgcctcccaataaaatg

SEQ ID NO: 17 - DNA, 21 bp, Artificial Sequence
  Description of Artificial Sequence: Synthetic oligonucleotide
  Description of Combined DNA/RNA Molecule: Synthetic oligonucleotide
cuuacgcugaguacuucgatt

SEQ ID NO: 18 - DNA, 21 bp, Artificial Sequence
  Description of Artificial Sequence: Synthetic oligonucleotide
  Description of Combined DNA/RNA Molecule: Synthetic oligonucleotide
ucgaaguacucagcguaagtt

SEQ ID NO: 19 - RNA, 21 nt, Artificial Sequence
  Description of Artificial Sequence: Synthetic oligonucleotide
aacuguggaaggaauaggaaa

SEQ ID NO: 20 - RNA, 21 nt, Artificial Sequence
  Description of Artificial Sequence: Synthetic oligonucleotide
aacuguggaaggaauaggaaa

SEQ ID NO: 21 - RNA, 21 nt, Artificial Sequence
  Description of Artificial Sequence: Synthetic oligonucleotide
gaggagauugagaaugccuua

SEQ ID NO: 22 - RNA, 21 nt, Artificial Sequence
  Description of Artificial Sequence: Synthetic oligonucleotide
gaggagauugagaaugccuua

SEQ ID NO: 23 - RNA, 21 nt, Artificial Sequence
  Description of Artificial Sequence: Synthetic oligonucleotide
gagauugagaaugccuuccaa

SEQ ID NO: 24 - RNA, 21 nt, Artificial Sequence
  Description of Artificial Sequence: Synthetic oligonucleotide
gagauugagaaugccuuccaa

SEQ ID NO: 25 - RNA, 21 nt, Artificial Sequence
  Description of Artificial Sequence: Synthetic oligonucleotide
guucaagaauaugcuguuuca

SEQ ID NO: 26 - RNA, 21 nt, Artificial Sequence
  Description of Artificial Sequence: Synthetic oligonucleotide
guucaagaauaugcuguuuca

SEQ ID NO: 27 - RNA, 21 nt, Artificial Sequence
  Description of Artificial Sequence: Synthetic oligonucleotide
aaaagacagagguguucagaa

SEQ ID NO: 28 - RNA, 21 nt, Artificial Sequence
  Description of Artificial Sequence: Synthetic oligonucleotide
aaaagacagagguguucagaa

SEQ ID NO: 29 - RNA, 21 nt, Artificial Sequence
  Description of Artificial Sequence: Synthetic oligonucleotide
aaagacagagguguucagaga

SEQ ID NO: 30 - RNA, 21 nt, Artificial Sequence
  Description of Artificial Sequence: Synthetic oligonucleotide
aaagacagagguguucagaga

SEQ ID NO: 31 - RNA, 21 nt, Artificial Sequence
  Description of Artificial Sequence: Synthetic oligonucleotide
cggagagaagaugacauugca

SEQ ID NO: 32 - RNA, 21 nt, Artificial Sequence
  Description of Artificial Sequence: Synthetic oligonucleotide
cggagagaagaugacauugca

SEQ ID NO: 33 - RNA, 21 nt, Artificial Sequence
  Description of Artificial Sequence: Synthetic oligonucleotide
agagaagaugacauugccaaa

SEQ ID NO: 34 - RNA, 21 nt, Artificial Sequence
  Description of Artificial Sequence: Synthetic oligonucleotide
agagaagaugacauugccaaa

SEQ ID NO: 35 - RNA, 21 nt, Artificial Sequence
  Description of Artificial Sequence: Synthetic oligonucleotide
gaagaugacauugccaaggua

SEQ ID NO: 36 - RNA, 21 nt, Artificial Sequence
  Description of Artificial Sequence: Synthetic oligonucleotide
gaagaugacauugccaaggua

SEQ ID NO: 37 - RNA, 21 nt, Artificial Sequence
  Description of Artificial Sequence: Synthetic oligonucleotide
cagucugaggaggacauggua

SEQ ID NO: 38 - RNA, 21 nt, Artificial Sequence
  Description of Artificial Sequence: Synthetic oligonucleotide
cagucugaggaggacauggua

SEQ ID NO: 39 - RNA, 21 nt, Artificial Sequence
  Description of Artificial Sequence: Synthetic oligonucleotide
aaggauaagguuacuuguguu

SEQ ID NO: 40 - RNA, 21 nt, Artificial Sequence
  Description of Artificial Sequence: Synthetic oligonucleotide
aaggauaagguuacuuguguu

SEQ ID NO: 41 - RNA, 21 nt, Artificial Sequence
  Description of Artificial Sequence: Synthetic oligonucleotide
aggauaagguuacuuguguua

SEQ ID NO: 42 - RNA, 21 nt, Artificial Sequence
  Description of Artificial Sequence: Synthetic oligonucleotide
aggauaagguuacuuguguua

SEQ ID NO: 43 - RNA, 21 nt, Artificial Sequence
  Description of Artificial Sequence: Synthetic oligonucleotide
cauaucauuggugcugugguu

SEQ ID NO: 44 - RNA, 21 nt, Artificial Sequence
  Description of Artificial Sequence: Synthetic oligonucleotide
cauaucauuggugcugugguu

SEQ ID NO: 45 - RNA, 21 nt, Artificial Sequence
  Description of Artificial Sequence: Synthetic oligonucleotide
gugaaaaucaccuaugaagaa

SEQ ID NO: 46 - RNA, 21 nt, Artificial Sequence
  Description of Artificial Sequence: Synthetic oligonucleotide
gugaaaaucaccuaugaagaa

SEQ ID NO: 47 - RNA, 21 nt, Artificial Sequence
  Description of Artificial Sequence: Synthetic oligonucleotide
acaauugaggaugcuauaaaa

SEQ ID NO: 48 - RNA, 21 nt, Artificial Sequence
  Description of Artificial Sequence: Synthetic oligonucleotide
acaauugaggaugcuauaaaa

SEQ ID NO: 49 - RNA, 21 nt, Artificial Sequence
  Description of Artificial Sequence: Synthetic oligonucleotide
ugcuauaaagaacaacuccuu

SEQ ID NO: 50 - RNA, 21 nt, Artificial Sequence
  Description of Artificial Sequence: Synthetic oligonucleotide
ugcuauaaagaacaacuccuu

SEQ ID NO: 51 - RNA, 21 nt, Artificial Sequence
  Description of Artificial Sequence: Synthetic oligonucleotide
gcuauaaagaacaacuccuuu

SEQ ID NO: 52 - RNA, 21 nt, Artificial Sequence
  Description of Artificial Sequence: Synthetic oligonucleotide
gcuauaaagaacaacuccuuu

SEQ ID NO: 53 - RNA, 21 nt, Artificial Sequence
  Description of Artificial Sequence: Synthetic oligonucleotide
uauaaagaacaacuccuuuua

SEQ ID NO: 54 - RNA, 21 nt, Artificial Sequence
  Description of Artificial Sequence: Synthetic oligonucleotide
uauaaagaacaacuccuuuua

SEQ ID NO: 55 - RNA, 21 nt, Artificial Sequence
  Description of Artificial Sequence: Synthetic oligonucleotide
uaaagaacaacuccuuuuaua

SEQ ID NO: 56 - RNA, 21 nt, Artificial Sequence
  Description of Artificial Sequence: Synthetic oligonucleotide
uaaagaacaacuccuuuuaua

SEQ ID NO: 57 - RNA, 21 nt, Artificial Sequence
  Description of Artificial Sequence: Synthetic oligonucleotide
gacaugcugauaacuggugga

SEQ ID NO: 58 - RNA, 21 nt, Artificial Sequence
  Description of Artificial Sequence: Synthetic oligonucleotide
gacaugcugauaacuggugga

SEQ ID NO: 59 - RNA, 21 nt, Artificial Sequence
  Description of Artificial Sequence: Synthetic oligonucleotide
augcugauaacugguggcaga

SEQ ID NO: 60 - RNA, 21 nt, Artificial Sequence
  Description of Artificial Sequence: Synthetic oligonucleotide
augcugauaacugguggcaga

SEQ ID NO: 61 - RNA, 21 nt, Artificial Sequence
  Description of Artificial Sequence: Synthetic oligonucleotide
ugauaacugguggcagacaua

SEQ ID NO: 62 - RNA, 21 nt, Artificial Sequence
  Description of Artificial Sequence: Synthetic oligonucleotide
ugauaacugguggcagacaua

SEQ ID NO: 63 - RNA, 21 nt, Artificial Sequence
  Description of Artificial Sequence: Synthetic oligonucleotide
uacaagguuggcuucaugaaa

SEQ ID NO: 64 - RNA, 21 nt, Artificial Sequence
  Description of Artificial Sequence: Synthetic oligonucleotide
uacaagguuggcuucaugaaa

SEQ ID NO: 65 - RNA, 21 nt, Artificial Sequence
  Description of Artificial Sequence: Synthetic oligonucleotide
acaagguuggcuucaugaaga

SEQ ID NO: 66 - RNA, 21 nt, Artificial Sequence
  Description of Artificial Sequence: Synthetic oligonucleotide
acaagguuggcuucaugaaga

SEQ ID NO: 67 - RNA, 21 nt, Artificial Sequence
  Description of Artificial Sequence: Synthetic oligonucleotide
aagcuugaggguuucaccuua

SEQ ID NO: 68 - RNA, 21 nt, Artificial Sequence
  Description of Artificial Sequence: Synthetic oligonucleotide
aagcuugaggguuucaccuua

SEQ ID NO: 69 - RNA, 21 nt, Artificial Sequence
  Description of Artificial Sequence: Synthetic oligonucleotide
aagagugagguugacaaguua

SEQ ID NO: 70 - RNA, 21 nt, Artificial Sequence
  Description of Artificial Sequence: Synthetic oligonucleotide
aagagugagguugacaaguua

SEQ ID NO: 71 - RNA, 21 nt, Artificial Sequence
  Description of Artificial Sequence: Synthetic oligonucleotide
guucaacaaggagaauuguua

SEQ ID NO: 72 - RNA, 21 nt, Artificial Sequence
  Description of Artificial Sequence: Synthetic oligonucleotide
guucaacaaggagaauuguua

SEQ ID NO: 73 - RNA, 21 nt, Artificial Sequence
  Description of Artificial Sequence: Synthetic oligonucleotide
acaaggagaauuguuggaaaa

SEQ ID NO: 74 - RNA, 21 nt, Artificial Sequence
  Description of Artificial Sequence: Synthetic oligonucleotide
acaaggagaauuguuggaaaa

SEQ ID NO: 75 - RNA, 21 nt, Artificial Sequence
  Description of Artificial Sequence: Synthetic oligonucleotide
accaaguuuggaauaagcuuu

SEQ ID NO: 76 - RNA, 21 nt, Artificial Sequence
  Description of Artificial Sequence: Synthetic oligonucleotide
accaaguuuggaauaagcuuu

SEQ ID NO: 77 - RNA, 21 nt, Artificial Sequence
  Description of Artificial Sequence: Synthetic oligonucleotide
uaucuucuuugccaucaaaga

SEQ ID NO: 78 - RNA, 21 nt, Artificial Sequence
  Description of Artificial Sequence: Synthetic oligonucleotide
uaucuucuuugccaucaaaga

SEQ ID NO: 79 - RNA, 21 nt, Artificial Sequence
  Description of Artificial Sequence: Synthetic oligonucleotide
ucuucuuugccaucaaagaua

SEQ ID NO: 80 - RNA, 21 nt, Artificial Sequence
  Description of Artificial Sequence: Synthetic oligonucleotide
ucuucuuugccaucaaagaua

SEQ ID NO: 81 - RNA, 21 nt, Artificial Sequence
  Description of Artificial Sequence: Synthetic oligonucleotide
cagaacauggaucuauuaaaa

SEQ ID NO: 82 - RNA, 21 nt, Artificial Sequence
  Description of Artificial Sequence: Synthetic oligonucleotide
cagaacauggaucuauuaaaa

SEQ ID NO: 83 - RNA, 21 nt, Artificial Sequence
  Description of Artificial Sequence: Synthetic oligonucleotide
acaaugauaagcaaauucaaa

SEQ ID NO: 84 - RNA, 21 nt, Artificial Sequence
  Description of Artificial Sequence: Synthetic oligonucleotide
acaaugauaagcaaauucaaa

SEQ ID NO: 85 - RNA, 21 nt, Artificial Sequence
  Description of Artificial Sequence: Synthetic oligonucleotide
aauggugaauaugcaauuaga

SEQ ID NO: 86 - RNA, 21 nt, Artificial Sequence
  Description of Artificial Sequence: Synthetic oligonucleotide
aauggugaauaugcaauuaga

SEQ ID NO: 87 - RNA, 21 nt, Artificial Sequence
  Description of Artificial Sequence: Synthetic oligonucleotide
accaaugaacagcaaagcaua

SEQ ID NO: 88 - RNA, 21 nt, Artificial Sequence
  Description of Artificial Sequence: Synthetic oligonucleotide
accaaugaacagcaaagcaua

SEQ ID NO: 89 - RNA, 21 nt, Artificial Sequence
  Description of Artificial Sequence: Synthetic oligonucleotide
ccaucuuugaaucauuggaaa

SEQ ID NO: 90 - RNA, 21 nt, Artificial Sequence
  Description of Artificial Sequence: Synthetic oligonucleotide
ccaucuuugaaucauuggaaa

SEQ ID NO: 91 - RNA, 21 nt, Artificial Sequence
  Description of Artificial Sequence: Synthetic oligonucleotide
aagaauaaagaaugaaacaaa

SEQ ID NO: 92 - RNA, 21 nt, Artificial Sequence
  Description of Artificial Sequence: Synthetic oligonucleotide
aagaauaaagaaugaaacaaa

SEQ ID NO: 93 - RNA, 21 nt, Artificial Sequence
  Description of Artificial Sequence: Synthetic oligonucleotide
aauaaagaaugaaacaaauua

SEQ ID NO: 94 - RNA, 21 nt, Artificial Sequence
  Description of Artificial Sequence: Synthetic oligonucleotide
aauaaagaaugaaacaaauua

SEQ ID NO: 95 - RNA, 21 nt, Artificial Sequence
  Description of Artificial Sequence: Synthetic oligonucleotide
auccaaccaacucaauuauua

SEQ ID NO: 96 - RNA, 21 nt, Artificial Sequence
  Description of Artificial Sequence: Synthetic oligonucleotide
auccaaccaacucaauuauua

SEQ ID NO: 97 - RNA, 21 nt, Artificial Sequence
  Description of Artificial Sequence: Synthetic oligonucleotide
cacuguauaaauccaaccuua

SEQ ID NO: 98 - RNA, 21 nt, Artificial Sequence
  Description of Artificial Sequence: Synthetic oligonucleotide
cacuguauaaauccaaccuua

SEQ ID NO: 99 - RNA, 21 nt, Artificial Sequence
  Description of Artificial Sequence: Synthetic oligonucleotide
aacuguggaaggcauaggaaa

SEQ ID NO: 100 - RNA, 21 nt, Artificial Sequence
  Description of Artificial Sequence: Synthetic oligonucleotide
ggauuucaaaccuuuagauca

SEQ ID NO: 101 - RNA, 21 nt, Artificial Sequence
  Description of Artificial Sequence: Synthetic oligonucleotide
acagagauaggcauugaaaua

SEQ ID NO: 102 - RNA, 21 nt, Artificial Sequence
  Description of Artificial Sequence: Synthetic oligonucleotide
ggcauugaaaugaaauuuaaa

SEQ ID NO: 103 - RNA, 21 nt, Artificial Sequence
  Description of Artificial Sequence: Synthetic oligonucleotide
acaauccaggaugcuauaaaa

SEQ ID NO: 104 - RNA, 21 nt, Artificial Sequence
  Description of Artificial Sequence: Synthetic oligonucleotide
caagauggaaguggagaaauu

SEQ ID NO: 105 - RNA, 23 nt, Artificial Sequence
  Description of Artificial Sequence: Synthetic oligonucleotide
uuuccuauuccuuccacaguugu

SEQ ID NO: 106 - RNA, 23 nt, Artificial Sequence
  Description of Artificial Sequence: Synthetic oligonucleotide
uuuccuauuccuuccacaguugu

SEQ ID NO: 107 - RNA, 23 nt, Artificial Sequence
  Description of Artificial Sequence: Synthetic oligonucleotide
uaaggcauucucaaucuccucca

SEQ ID NO: 108 - RNA, 23 nt, Artificial Sequence
  Description of Artificial Sequence: Synthetic oligonucleotide
uaaggcauucucaaucuccucca

SEQ ID NO: 109 - RNA, 23 nt, Artificial Sequence
  Description of Artificial Sequence: Synthetic oligonucleotide
uuggaaggcauucucaaucuccu

SEQ ID NO: 110 - RNA, 23 nt, Artificial Sequence
  Description of Artificial Sequence: Synthetic oligonucleotide
uuggaaggcauucucaaucuccu

SEQ ID NO: 111 - RNA, 23 nt, Artificial Sequence
  Description of Artificial Sequence: Synthetic oligonucleotide
ugaaacagcauauucuugaacuu

SEQ ID NO: 112 - RNA, 23 nt, Artificial Sequence
  Description of Artificial Sequence: Synthetic oligonucleotide
ugaaacagcauauucuugaacuu

SEQ ID NO: 113 - RNA, 23 nt, Artificial Sequence
  Description of Artificial Sequence: Synthetic oligonucleotide
uucugaacaccucugucuuuugg

SEQ ID NO: 114 - RNA, 23 nt, Artificial Sequence
  Description of Artificial Sequence: Synthetic oligonucleotide
uucugaacaccucugucuuuugg

SEQ ID NO: 115 - RNA, 23 nt, Artificial Sequence
  Description of Artificial Sequence: Synthetic oligonucleotide
ucucugaacaccucugucuuuug

SEQ ID NO: 116 - RNA, 23 nt, Artificial Sequence
  Description of Artificial Sequence: Synthetic oligonucleotide
ucucugaacaccucugucuuuug

SEQ ID NO: 117 - RNA, 23 nt, Artificial Sequence
  Description of Artificial Sequence: Synthetic oligonucleotide
ugcaaugucaucuucucuccggg

SEQ ID NO: 118 - RNA, 23 nt, Artificial Sequence
  Description of Artificial Sequence: Synthetic oligonucleotide
ugcaaugucaucuucucuccggg

SEQ ID NO: 119 - RNA, 23 nt, Artificial Sequence
  Description of Artificial Sequence: Synthetic oligonucleotide
uuuggcaaugucaucuucucucc

SEQ ID NO: 120 - RNA, 23 nt, Artificial Sequence
  Description of Artificial Sequence: Synthetic oligonucleotide
uuuggcaaugucaucuucucucc

SEQ ID NO: 121 - RNA, 23 nt, Artificial Sequence
  Description of Artificial Sequence: Synthetic oligonucleotide
uaccuuggcaaugucaucuucuc

SEQ ID NO: 122 - RNA, 23 nt, Artificial Sequence
  Description of Artificial Sequence: Synthetic oligonucleotide
uaccuuggcaaugucaucuucuc

SEQ ID NO: 123 - RNA, 23 nt, Artificial Sequence
  Description of Artificial Sequence: Synthetic oligonucleotide
uaccauguccuccucagacugac

SEQ ID NO: 124 - RNA, 23 nt, Artificial Sequence
  Description of Artificial Sequence: Synthetic oligonucleotide
uaccauguccuccucagacugac

SEQ ID NO: 125 - RNA, 23 nt, Artificial Sequence
  Description of Artificial Sequence: Synthetic oligonucleotide
aacacaaguaaccuuauccuucg

SEQ ID NO: 126 - RNA, 23 nt, Artificial Sequence
  Description of Artificial Sequence: Synthetic oligonucleotide
aacacaaguaaccuuauccuucg

SEQ ID NO: 127 - RNA, 23 nt, Artificial Sequence
  Description of Artificial Sequence: Synthetic oligonucleotide
uaacacaaguaaccuuauccuuc

SEQ ID NO: 128 - RNA, 23 nt, Artificial Sequence
  Description of Artificial Sequence: Synthetic oligonucleotide
uaacacaaguaaccuuauccuuc

SEQ ID NO: 129 - RNA, 23 nt, Artificial Sequence
  Description of Artificial Sequence: Synthetic oligonucleotide
aaccacagcaccaaugauaugcc

SEQ ID NO: 130 - RNA, 23 nt, Artificial Sequence
  Description of Artificial Sequence: Synthetic oligonucleotide
aaccacagcaccaaugauaugcc

SEQ ID NO: 131 - RNA, 23 nt, Artificial Sequence
  Description of Artificial Sequence: Synthetic oligonucleotide
uucuucauaggugauuuucaccc

SEQ ID NO: 132 - RNA, 23 nt, Artificial Sequence
  Description of Artificial Sequence: Synthetic oligonucleotide
uucuucauaggugauuuucaccc

SEQ ID NO: 133 - RNA, 23 nt, Artificial Sequence
  Description of Artificial Sequence: Synthetic oligonucleotide
uuuuauagcauccucaauuguga

SEQ ID NO: 134 - RNA, 23 nt, Artificial Sequence
  Description of Artificial Sequence: Synthetic oligonucleotide
uuuuauagcauccucaauuguga

SEQ ID NO: 135 - RNA, 23 nt, Artificial Sequence
  Description of Artificial Sequence: Synthetic oligonucleotide
aaggaguuguucuuuauagcauc

SEQ ID NO: 136 - RNA, 23 nt, Artificial Sequence
  Description of Artificial Sequence: Synthetic oligonucleotide
aaggaguuguucuuuauagcauc

SEQ ID NO: 137 - RNA, 23 nt, Artificial Sequence
  Description of Artificial Sequence: Synthetic oligonucleotide
aaaggaguuguucuuuauagcau

SEQ ID NO: 138 - RNA, 23 nt, Artificial Sequence
  Description of Artificial Sequence: Synthetic oligonucleotide
aaaggaguuguucuuuauagcau

SEQ ID NO: 139 - RNA, 23 nt, Artificial Sequence
  Description of Artificial Sequence: Synthetic oligonucleotide
uaaaaggaguuguucuuuauagc

SEQ ID NO: 140 - RNA, 23 nt, Artificial Sequence
  Description of Artificial Sequence: Synthetic oligonucleotide
uaaaaggaguuguucuuuauagc

SEQ ID NO: 141 - RNA, 23 nt, Artificial Sequence
  Description of Artificial Sequence: Synthetic oligonucleotide
uauaaaaggaguuguucuuuaua

SEQ ID NO: 142 - RNA, 23 nt, Artificial Sequence
  Description of Artificial Sequence: Synthetic oligonucleotide
uauaaaaggaguuguucuuuaua

SEQ ID NO: 143 - RNA, 23 nt, Artificial Sequence
  Description of Artificial Sequence: Synthetic oligonucleotide
uccaccaguuaucagcauguccu

SEQ ID NO: 144 - RNA, 23 nt, Artificial Sequence
  Description of Artificial Sequence: Synthetic oligonucleotide
uccaccaguuaucagcauguccu

SEQ ID NO: 145 - RNA, 23 nt, Artificial Sequence
  Description of Artificial Sequence: Synthetic oligonucleotide
ucugccaccaguuaucagcaugu

SEQ ID NO: 146 - RNA, 23 nt, Artificial Sequence
  Description of Artificial Sequence: Synthetic oligonucleotide
ucugccaccaguuaucagcaugu

SEQ ID NO: 147 - RNA, 23 nt, Artificial Sequence
  Description of Artificial Sequence: Synthetic oligonucleotide
uaugucugccaccaguuaucagc

SEQ ID NO: 148 - RNA, 23 nt, Artificial Sequence
  Description of Artificial Sequence: Synthetic oligonucleotide
uaugucugccaccaguuaucagc

SEQ ID NO: 149 - RNA, 23 nt, Artificial Sequence
  Description of Artificial Sequence: Synthetic oligonucleotide
uuucaugaagccaaccuuguauc

SEQ ID NO: 150 - RNA, 23 nt, Artificial Sequence
  Description of Artificial Sequence: Synthetic oligonucleotide
uuucaugaagccaaccuuguauc

SEQ ID NO: 151 - RNA, 23 nt, Artificial Sequence
  Description of Artificial Sequence: Synthetic oligonucleotide
ucuucaugaagccaaccuuguau

SEQ ID NO: 152 - RNA, 23 nt, Artificial Sequence
  Description of Artificial Sequence: Synthetic oligonucleotide
ucuucaugaagccaaccuuguau

SEQ ID NO: 153 - RNA, 23 nt, Artificial Sequence
  Description of Artificial Sequence: Synthetic oligonucleotide
uaaggugaaacccucaagcuucu

SEQ ID NO: 154 - RNA, 23 nt, Artificial Sequence
  Description of Artificial Sequence: Synthetic oligonucleotide
uaaggugaaacccucaagcuucu

SEQ ID NO: 155 - RNA, 23 nt, Artificial Sequence
  Description of Artificial Sequence: Synthetic oligonucleotide
uaacuugucaaccucacucuucc

SEQ ID NO: 156 - RNA, 23 nt, Artificial Sequence
  Description of Artificial Sequence: Synthetic oligonucleotide
uaacuugucaaccucacucuucc

SEQ ID NO: 157 - RNA, 23 nt, Artificial Sequence
  Description of Artificial Sequence: Synthetic oligonucleotide
uaacaauucuccuuguugaacuu

SEQ ID NO: 158 - RNA, 23 nt, Artificial Sequence
  Description of Artificial Sequence: Synthetic oligonucleotide
uaacaauucuccuuguugaacuu

SEQ ID NO: 159 - RNA, 23 nt, Artificial Sequence
  Description of Artificial Sequence: Synthetic oligonucleotide
uuuuccaacaauucuccuuguug

SEQ ID NO: 160 - RNA, 23 nt, Artificial Sequence
  Description of Artificial Sequence: Synthetic oligonucleotide
uuuuccaacaauucuccuuguug

SEQ ID NO: 161 - RNA, 23 nt, Artificial Sequence
  Description of Artificial Sequence: Synthetic oligonucleotide
aaagcuuauuccaaacuuggugg

SEQ ID NO: 162 - RNA, 23 nt, Artificial Sequence
  Description of Artificial Sequence: Synthetic oligonucleotide
aaagcuuauuccaaacuuggugg

SEQ ID NO: 163 - RNA, 23 nt, Artificial Sequence
  Description of Artificial Sequence: Synthetic oligonucleotide
ucuuugauggcaaagaagauaga

SEQ ID NO: 164 - RNA, 23 nt, Artificial Sequence
  Description of Artificial Sequence: Synthetic oligonucleotide
ucuuugauggcaaagaagauaga

SEQ ID NO: 165 - RNA, 23 nt, Artificial Sequence
  Description of Artificial Sequence: Synthetic oligonucleotide
uaucuuugauggcaaagaagaua

SEQ ID NO: 166 - RNA, 23 nt, Artificial Sequence
  Description of Artificial Sequence: Synthetic oligonucleotide
uaucuuugauggcaaagaagaua

SEQ ID NO: 167 - RNA, 23 nt, Artificial Sequence
  Description of Artificial Sequence: Synthetic oligonucleotide
uuuuaauagauccauguucugug

SEQ ID NO: 168 - RNA, 23 nt, Artificial Sequence
  Description of Artificial Sequence: Synthetic oligonucleotide
uuuuaauagauccauguucugug

SEQ ID NO: 169 - RNA, 23 nt, Artificial Sequence
  Description of Artificial Sequence: Synthetic oligonucleotide
uuugaauuugcuuaucauugugu

SEQ ID NO: 170 - RNA, 23 nt, Artificial Sequence
  Description of Artificial Sequence: Synthetic oligonucleotide
uuugaauuugcuuaucauugugu

SEQ ID NO: 171 - RNA, 23 nt, Artificial Sequence
  Description of Artificial Sequence: Synthetic oligonucleotide
ucuaauugcauauucaccauuua

SEQ ID NO: 172 - RNA, 23 nt, Artificial Sequence
  Description of Artificial Sequence: Synthetic oligonucleotide
ucuaauugcauauucaccauuua

SEQ ID NO: 173 - RNA, 23 nt, Artificial Sequence
  Description of Artificial Sequence: Synthetic oligonucleotide
uaugcuuugcuguucauugguuu

SEQ ID NO: 174 - RNA, 23 nt, Artificial Sequence
  Description of Artificial Sequence: Synthetic oligonucleotide
uaugcuuugcuguucauugguuu

SEQ ID NO: 175 - RNA, 23 nt, Artificial Sequence
  Description of Artificial Sequence: Synthetic oligonucleotide
uuuccaaugauucaaagaugguu

SEQ ID NO: 176 - RNA, 23 nt, Artificial Sequence
  Description of Artificial Sequence: Synthetic oligonucleotide
uuuccaaugauucaaagaugguu

SEQ ID NO: 177 - RNA, 23 nt, Artificial Sequence
  Description of Artificial Sequence: Synthetic oligonucleotide
uuuguuucauucuuuauucuuuc

SEQ ID NO: 178 - RNA, 23 nt, Artificial Sequence
  Description of Artificial Sequence: Synthetic oligonucleotide
uuuguuucauucuuuauucuuuc

SEQ ID NO: 179 - RNA, 23 nt, Artificial Sequence
  Description of Artificial Sequence: Synthetic oligonucleotide
uaauuuguuucauucuuuauucu

SEQ ID NO: 180 - RNA, 23 nt, Artificial Sequence
  Description of Artificial Sequence: Synthetic oligonucleotide
uaauuuguuucauucuuuauucu

SEQ ID NO: 181 - RNA, 23 nt, Artificial Sequence
  Description of Artificial Sequence: Synthetic oligonucleotide
uaauaauugaguugguuggauuu

SEQ ID NO: 182 - RNA, 23 nt, Artificial Sequence
  Description of Artificial Sequence: Synthetic oligonucleotide
uaauaauugaguugguuggauuu

SEQ ID NO: 183 - RNA, 23 nt, Artificial Sequence
  Description of Artificial Sequence: Synthetic oligonucleotide
uaagguuggauuuauacagugaa

SEQ ID NO: 184 - RNA, 23 nt, Artificial Sequence
  Description of Artificial Sequence: Synthetic oligonucleotide
uaagguuggauuuauacagugaa

SEQ ID NO: 185 - RNA, 23 nt, Artificial Sequence
  Description of Artificial Sequence: Synthetic oligonucleotide
uuuccuaugccuuccacaguugu

SEQ ID NO: 186 - RNA, 23 nt, Artificial Sequence
  Description of Artificial Sequence: Synthetic oligonucleotide
ugaucuaaagguuugaaauccuc

SEQ ID NO: 187 - RNA, 23 nt, Artificial Sequence
  Description of Artificial Sequence: Synthetic oligonucleotide
uauuucaaugccuaucucugugu

SEQ ID NO: 188 - RNA, 23 nt, Artificial Sequence
  Description of Artificial Sequence: Synthetic oligonucleotide
uuuaaauuucauuucaaugccua

SEQ ID NO: 189 - RNA, 23 nt, Artificial Sequence
  Description of Artificial Sequence: Synthetic oligonucleotide
uuuuauagcauccuggauuguga

SEQ ID NO: 190 - RNA, 23 nt, Artificial Sequence
  Description of Artificial Sequence: Synthetic oligonucleotide
aauuucuccacuuccaucuugcg

SEQ ID NO: 191 - DNA, 23 bp, Artificial Sequence
  Description of Artificial Sequence: Synthetic oligonucleotide
  Description of Combined DNA/RNA Molecule: Synthetic oligonucleotide
aacuguggaaggaauaggaaatt

SEQ ID NO: 192 - RNA, 21 nt, Artificial Sequence
  Description of Artificial Sequence: Synthetic oligonucleotide
aacuguggaaggaauaggaaa

SEQ ID NO: 193 - DNA, 23 bp, Artificial Sequence
  Description of Artificial Sequence: Synthetic oligonucleotide
  Description of Combined DNA/RNA Molecule: Synthetic oligonucleotide
gaggagauugagaaugccuuatt

SEQ ID NO: 194 - RNA, 21 nt, Artificial Sequence
  Description of Artificial Sequence: Synthetic oligonucleotide
gaggagauugagaaugccuua

SEQ ID NO: 195 - DNA, 23 bp, Artificial Sequence
  Description of Artificial Sequence: Synthetic oligonucleotide
  Description of Combined DNA/RNA Molecule: Synthetic oligonucleotide
gagauugagaaugccuuccaatt

SEQ ID NO: 196 - RNA, 21 nt, Artificial Sequence
  Description of Artificial Sequence: Synthetic oligonucleotide
gagauugagaaugccuuccaa

SEQ ID NO: 197 - DNA, 23 bp, Artificial Sequence
  Description of Artificial Sequence: Synthetic oligonucleotide
  Description of Combined DNA/RNA Molecule: Synthetic oligonucleotide
guucaagaauaugcuguuucatt

SEQ ID NO: 198 - RNA, 21 nt, Artificial Sequence
  Description of Artificial Sequence: Synthetic oligonucleotide
guucaagaauaugcuguuuca

SEQ ID NO: 199 - DNA, 23 bp, Artificial Sequence
  Description of Artificial Sequence: Synthetic oligonucleotide
  Description of Combined DNA/RNA Molecule: Synthetic oligonucleotide
aaaagacagagguguucagaatt

SEQ ID NO: 200 - RNA, 21 nt, Artificial Sequence
  Description of Artificial Sequence: Synthetic oligonucleotide
aaaagacagagguguucagaa

SEQ ID NO: 201 - DNA, 23 bp, Artificial Sequence
  Description of Artificial Sequence: Synthetic oligonucleotide
  Description of Combined DNA/RNA Molecule: Synthetic oligonucleotide
aaagacagagguguucagagatt

SEQ ID NO: 202 - RNA, 21 nt, Artificial Sequence
  Description of Artificial Sequence: Synthetic oligonucleotide
aaagacagagguguucagaga

SEQ ID NO: 203 - DNA, 23 bp, Artificial Sequence
  Description of Artificial Sequence: Synthetic oligonucleotide
  Description of Combined DNA/RNA Molecule: Synthetic oligonucleotide
cggagagaagaugacauugcatt

SEQ ID NO: 204 - RNA, 21 nt, Artificial Sequence
  Description of Artificial Sequence: Synthetic oligonucleotide
cggagagaagaugacauugca

SEQ ID NO: 205 - DNA, 23 bp, Artificial Sequence
  Description of Artificial Sequence: Synthetic oligonucleotide
  Description of Combined DNA/RNA Molecule: Synthetic oligonucleotide
agagaagaugacauugccaaatt

SEQ ID NO: 206 - RNA, 21 nt, Artificial Sequence
  Description of Artificial Sequence: Synthetic oligonucleotide
agagaagaugacauugccaaa

SEQ ID NO: 207 - DNA, 23 bp, Artificial Sequence
  Description of Artificial Sequence: Synthetic oligonucleotide
  Description of Combined DNA/RNA Molecule: Synthetic oligonucleotide
gaagaugacauugccaagguatt

SEQ ID NO: 208 - RNA, 21 nt, Artificial Sequence
  Description of Artificial Sequence: Synthetic oligonucleotide
gaagaugacauugccaaggua

SEQ ID NO: 209 - DNA, 23 bp, Artificial Sequence
  Description of Artificial Sequence: Synthetic oligonucleotide
  Description of Combined DNA/RNA Molecule: Synthetic oligonucleotide
cagucugaggaggacaugguatt

SEQ ID NO: 210 - RNA, 21 nt, Artificial Sequence
  Description of Artificial Sequence: Synthetic oligonucleotide
cagucugaggaggacauggua

SEQ ID NO: 211 - DNA, 23 bp, Artificial Sequence
  Description of Artificial Sequence: Synthetic oligonucleotide
  Description of Combined DNA/RNA Molecule: Synthetic oligonucleotide
aaggauaagguuacuuguguutt

SEQ ID NO: 212 - RNA, 21 nt, Artificial Sequence
  Description of Artificial Sequence: Synthetic oligonucleotide
aaggauaagguuacuuguguu

SEQ ID NO: 213 - DNA, 23 bp, Artificial Sequence
  Description of Artificial Sequence: Synthetic oligonucleotide
  Description of Combined DNA/RNA Molecule: Synthetic oligonucleotide
aggauaagguuacuuguguuatt

SEQ ID NO: 214 - RNA, 21 nt, Artificial Sequence
  Description of Artificial Sequence: Synthetic oligonucleotide
aggauaagguuacuuguguua

SEQ ID NO: 215 - DNA, 23 bp, Artificial Sequence
  Description of Artificial Sequence: Synthetic oligonucleotide
  Description of Combined DNA/RNA Molecule: Synthetic oligonucleotide
cauaucauuggugcugugguutt

SEQ ID NO: 216 - RNA, 21 nt, Artificial Sequence
  Description of Artificial Sequence: Synthetic oligonucleotide
cauaucauuggugcugugguu

SEQ ID NO: 217 - DNA, 23 bp, Artificial Sequence
  Description of Artificial Sequence: Synthetic oligonucleotide
  Description of Combined DNA/RNA Molecule: Synthetic oligonucleotide
gugaaaaucaccuaugaagaatt

SEQ ID NO: 218 - RNA, 21 nt, Artificial Sequence
  Description of Artificial Sequence: Synthetic oligonucleotide
gugaaaaucaccuaugaagaa

SEQ ID NO: 219 - DNA, 23 bp, Artificial Sequence
  Description of Artificial Sequence: Synthetic oligonucleotide
  Description of Combined DNA/RNA Molecule: Synthetic oligonucleotide
acaauugaggaugcuauaaaatt

SEQ ID NO: 220 - RNA, 21 nt, Artificial Sequence
  Description of Artificial Sequence: Synthetic oligonucleotide
acaauugaggaugcuauaaaa

SEQ ID NO: 221 - DNA, 23 bp, Artificial Sequence
  Description of Artificial Sequence: Synthetic oligonucleotide
  Description of Combined DNA/RNA Molecule: Synthetic oligonucleotide
ugcuauaaagaacaacuccuutt

SEQ ID NO: 222 - RNA, 21 nt, Artificial Sequence
  Description of Artificial Sequence: Synthetic oligonucleotide
ugcuauaaagaacaacuccuu

SEQ ID NO: 223 - DNA, 23 bp, Artificial Sequence
  Description of Artificial Sequence: Synthetic oligonucleotide
  Description of Combined DNA/RNA Molecule: Synthetic oligonucleotide
gcuauaaagaacaacuccuuutt

SEQ ID NO: 224 - RNA, 21 nt, Artificial Sequence
  Description of Artificial Sequence: Synthetic oligonucleotide
gcuauaaagaacaacuccuuu

SEQ ID NO: 225 - DNA, 23 bp, Artificial Sequence
  Description of Artificial Sequence: Synthetic oligonucleotide
  Description of Combined DNA/RNA Molecule: Synthetic oligonucleotide
uauaaagaacaacuccuuuuatt

SEQ ID NO: 226 - RNA, 21 nt, Artificial Sequence
  Description of Artificial Sequence: Synthetic oligonucleotide
uauaaagaacaacuccuuuua

SEQ ID NO: 227 - DNA, 23 bp, Artificial Sequence
  Description of Artificial Sequence: Synthetic oligonucleotide
  Description of Combined DNA/RNA Molecule: Synthetic oligonucleotide
uaaagaacaacuccuuuuauatt

SEQ ID NO: 228 - RNA, 21 nt, Artificial Sequence
  Description of Artificial Sequence: Synthetic oligonucleotide
uaaagaacaacuccuuuuaua

SEQ ID NO: 229 - DNA, 23 bp, Artificial Sequence
  Description of Artificial Sequence: Synthetic oligonucleotide
  Description of Combined DNA/RNA Molecule: Synthetic oligonucleotide
gacaugcugauaacugguggatt

SEQ ID NO: 230 - RNA, 21 nt, Artificial Sequence
  Description of Artificial Sequence: Synthetic oligonucleotide
gacaugcugauaacuggugga

SEQ ID NO: 231 - DNA, 23 bp, Artificial Sequence
  Description of Artificial Sequence: Synthetic oligonucleotide
  Description of Combined DNA/RNA Molecule: Synthetic oligonucleotide
augcugauaacugguggcagatt

SEQ ID NO: 232 - RNA, 21 nt, Artificial Sequence
  Description of Artificial Sequence: Synthetic oligonucleotide
augcugauaacugguggcaga

SEQ ID NO: 233 - DNA, 23 bp, Artificial Sequence
  Description of Artificial Sequence: Synthetic oligonucleotide
  Description of Combined DNA/RNA Molecule: Synthetic oligonucleotide
ugauaacugguggcagacauatt

SEQ ID NO: 234 - RNA, 21 nt, Artificial Sequence
  Description of Artificial Sequence: Synthetic oligonucleotide
ugauaacugguggcagacaua

SEQ ID NO: 235 - DNA, 23 bp, Artificial Sequence
  Description of Artificial Sequence: Synthetic oligonucleotide
  Description of Combined DNA/RNA Molecule: Synthetic oligonucleotide
uacaagguuggcuucaugaaatt

SEQ ID NO: 236 - RNA, 21 nt, Artificial Sequence
  Description of Artificial Sequence: Synthetic oligonucleotide
uacaagguuggcuucaugaaa

SEQ ID NO: 237 - DNA, 23 bp, Artificial Sequence
  Description of Artificial Sequence: Synthetic oligonucleotide
  Description of Combined DNA/RNA Molecule: Synthetic oligonucleotide
acaagguuggcuucaugaagatt

SEQ ID NO: 238 - RNA, 21 nt, Artificial Sequence
  Description of Artificial Sequence: Synthetic oligonucleotide
acaagguuggcuucaugaaga

SEQ ID NO: 239 - DNA, 23 bp, Artificial Sequence
  Description of Artificial Sequence: Synthetic oligonucleotide
  Description of Combined DNA/RNA Molecule: Synthetic oligonucleotide
aagcuugaggguuucaccuuatt

SEQ ID NO: 240 - RNA, 21 nt, Artificial Sequence
  Description of Artificial Sequence: Synthetic oligonucleotide
aagcuugaggguuucaccuua

SEQ ID NO: 241 - DNA, 23 bp, Artificial Sequence
  Description of Artificial Sequence: Synthetic oligonucleotide
  Description of Combined DNA/RNA Molecule: Synthetic oligonucleotide
aagagugagguugacaaguuatt

SEQ ID NO: 242 - RNA, 21 nt, Artificial Sequence
  Description of Artificial Sequence: Synthetic oligonucleotide
aagagugagguugacaaguua

SEQ ID NO: 243 - DNA, 23 bp, Artificial Sequence
  Description of Artificial Sequence: Synthetic oligonucleotide
  Description of Combined DNA/RNA Molecule: Synthetic oligonucleotide
guucaacaaggagaauuguuatt

SEQ ID NO: 244 - RNA, 21 nt, Artificial Sequence
  Description of Artificial Sequence: Synthetic oligonucleotide
guucaacaaggagaauuguua

SEQ ID NO: 245 - DNA, 23 bp, Artificial Sequence
  Description of Artificial Sequence: Synthetic oligonucleotide
  Description of Combined DNA/RNA Molecule: Synthetic oligonucleotide
acaaggagaauuguuggaaaatt

SEQ ID NO: 246 - RNA, 21 nt, Artificial Sequence
  Description of Artificial Sequence: Synthetic oligonucleotide
acaaggagaauuguuggaaaa

SEQ ID NO: 247 - DNA, 23 bp, Artificial Sequence
  Description of Artificial Sequence: Synthetic oligonucleotide
  Description of Combined DNA/RNA Molecule: Synthetic oligonucleotide
accaaguuuggaauaagcuuutt

SEQ ID NO: 248 - RNA, 21 nt, Artificial Sequence
  Description of Artificial Sequence: Synthetic oligonucleotide
accaaguuuggaauaagcuuu

SEQ ID NO: 249 - DNA, 23 bp, Artificial Sequence
  Description of Artificial Sequence: Synthetic oligonucleotide
  Description of Combined DNA/RNA Molecule: Synthetic oligonucleotide
uaucuucuuugccaucaaagatt

SEQ ID NO: 250 - RNA, 21 nt, Artificial Sequence
  Description of Artificial Sequence: Synthetic oligonucleotide
uaucuucuuugccaucaaaga

SEQ ID NO: 251 - DNA, 23 bp, Artificial Sequence
  Description of Artificial Sequence: Synthetic oligonucleotide
  Description of Combined DNA/RNA Molecule: Synthetic oligonucleotide
ucuucuuugccaucaaagauatt

SEQ ID NO: 252 - RNA, 21 nt, Artificial Sequence
  Description of Artificial Sequence: Synthetic oligonucleotide
ucuucuuugccaucaaagaua

SEQ ID NO: 253 - DNA, 23 bp, Artificial Sequence
  Description of Artificial Sequence: Synthetic oligonucleotide
  Description of Combined DNA/RNA Molecule: Synthetic oligonucleotide
cagaacauggaucuauuaaaatt

SEQ ID NO: 254 - RNA, 21 nt, Artificial Sequence
  Description of Artificial Sequence: Synthetic oligonucleotide
cagaacauggaucuauuaaaa

SEQ ID NO: 255 - DNA, 23 bp, Artificial Sequence
  Description of Artificial Sequence: Synthetic oligonucleotide
  Description of Combined DNA/RNA Molecule: Synthetic oligonucleotide
acaaugauaagcaaauucaaatt

SEQ ID NO: 256 - RNA, 21 nt, Artificial Sequence
  Description of Artificial Sequence: Synthetic oligonucleotide
acaaugauaagcaaauucaaa

SEQ ID NO: 257 - DNA, 23 bp, Artificial Sequence
  Description of Artificial Sequence: Synthetic oligonucleotide
  Description of Combined DNA/RNA Molecule: Synthetic oligonucleotide
aauggugaauaugcaauuagatt

SEQ ID NO: 258 - RNA, 21 nt, Artificial Sequence
  Description of Artificial Sequence: Synthetic oligonucleotide
aauggugaauaugcaauuaga

SEQ ID NO: 259 - DNA, 23 bp, Artificial Sequence
  Description of Artificial Sequence: Synthetic oligonucleotide
  Description of Combined DNA/RNA Molecule: Synthetic oligonucleotide
accaaugaacagcaaagcauatt

SEQ ID NO: 260 - RNA, 21 nt, Artificial Sequence
  Description of Artificial Sequence: Synthetic oligonucleotide
accaaugaacagcaaagcaua

SEQ ID NO: 261 - DNA, 23 bp, Artificial Sequence
  Description of Artificial Sequence: Synthetic oligonucleotide
  Description of Combined DNA/RNA Molecule: Synthetic oligonucleotide
ccaucuuugaaucauuggaaatt

SEQ ID NO: 262 - RNA, 21 nt, Artificial Sequence
  Description of Artificial Sequence: Synthetic oligonucleotide
ccaucuuugaaucauuggaaa

SEQ ID NO: 263 - DNA, 23 bp, Artificial Sequence
  Description of Artificial Sequence: Synthetic oligonucleotide
  Description of Combined DNA/RNA Molecule: Synthetic oligonucleotide
aagaauaaagaaugaaacaaatt

SEQ ID NO: 264 - RNA, 21 nt, Artificial Sequence
  Description of Artificial Sequence: Synthetic oligonucleotide
aagaauaaagaaugaaacaaa

SEQ ID NO: 265 - DNA, 23 bp, Artificial Sequence
  Description of Artificial Sequence: Synthetic oligonucleotide
  Description of Combined DNA/RNA Molecule: Synthetic oligonucleotide
aauaaagaaugaaacaaauuatt

SEQ ID NO: 266 - RNA, 21 nt, Artificial Sequence
  Description of Artificial Sequence: Synthetic oligonucleotide
aauaaagaaugaaacaaauua

SEQ ID NO: 267 - DNA, 23 bp, Artificial Sequence
  Description of Artificial Sequence: Synthetic oligonucleotide
  Description of Combined DNA/RNA Molecule: Synthetic oligonucleotide
auccaaccaacucaauuauuatt

SEQ ID NO: 268 - RNA, 21 nt, Artificial Sequence
  Description of Artificial Sequence: Synthetic oligonucleotide
auccaaccaacucaauuauua

SEQ ID NO: 269 - DNA, 23 bp, Artificial Sequence
  Description of Artificial Sequence: Synthetic oligonucleotide
  Description of Combined DNA/RNA Molecule: Synthetic oligonucleotide
cacuguauaaauccaaccuuatt

SEQ ID NO: 270 - RNA, 21 nt, Artificial Sequence
  Description of Artificial Sequence: Synthetic oligonucleotide
cacuguauaaauccaaccuua

SEQ ID NO: 271 - DNA, 23 bp, Artificial Sequence
  Description of Artificial Sequence: Synthetic oligonucleotide
  Description of Combined DNA/RNA Molecule: Synthetic oligonucleotide
aacuguggaaggcauaggaaatt

SEQ ID NO: 272 - DNA, 23 bp, Artificial Sequence
  Description of Artificial Sequence: Synthetic oligonucleotide
  Description of Combined DNA/RNA Molecule: Synthetic oligonucleotide
ggauuucaaaccuuuagaucatt

SEQ ID NO: 273 - DNA, 23 bp, Artificial Sequence
  Description of Artificial Sequence: Synthetic oligonucleotide
  Description of Combined DNA/RNA Molecule: Synthetic oligonucleotide
acagagauaggcauugaaauatt

SEQ ID NO: 274 - DNA, 23 bp, Artificial Sequence
  Description of Artificial Sequence: Synthetic oligonucleotide
  Description of Combined DNA/RNA Molecule: Synthetic oligonucleotide
ggcauugaaaugaaauuuaaatt

SEQ ID NO: 275 - DNA, 23 bp, Artificial Sequence
  Description of Artificial Sequence: Synthetic oligonucleotide
  Description of Combined DNA/RNA Molecule: Synthetic oligonucleotide
acaauccaggaugcuauaaaatt

SEQ ID NO: 276 - DNA, 23 bp, Artificial Sequence
  Description of Artificial Sequence: Synthetic oligonucleotide
  Description of Combined DNA/RNA Molecule: Synthetic oligonucleotide
caagauggaaguggagaaauutt

SEQ ID NO: 277 - DNA, 25 bp, Artificial Sequence
  Description of Artificial Sequence: Synthetic oligonucleotide
  Description of Combined DNA/RNA Molecule: Synthetic oligonucleotide
uuuccuauuccuuccacaguugutt

SEQ ID NO: 278 - RNA, 23 nt, Artificial Sequence
  Description of Artificial Sequence: Synthetic oligonucleotide
uuuccuauuccuuccacaguugu

SEQ ID NO: 279 - DNA, 25 bp, Artificial Sequence
  Description of Artificial Sequence: Synthetic oligonucleotide
  Description of Combined DNA/RNA Molecule: Synthetic oligonucleotide
uaaggcauucucaaucuccuccatt

SEQ ID NO: 280 - RNA, 23 nt, Artificial Sequence
  Description of Artificial Sequence: Synthetic oligonucleotide
uaaggcauucucaaucuccucca

SEQ ID NO: 281 - DNA, 25 bp, Artificial Sequence
  Description of Artificial Sequence: Synthetic oligonucleotide
  Description of Combined DNA/RNA Molecule: Synthetic oligonucleotide
uuggaaggcauucucaaucuccutt

SEQ ID NO: 282 - RNA, 23 nt, Artificial Sequence
  Description of Artificial Sequence: Synthetic oligonucleotide
uuggaaggcauucucaaucuccu

SEQ ID NO: 283 - DNA, 25 bp, Artificial Sequence
  Description of Artificial Sequence: Synthetic oligonucleotide
  Description of Combined DNA/RNA Molecule: Synthetic oligonucleotide
ugaaacagcauauucuugaacuutt

SEQ ID NO: 284 - RNA, 23 nt, Artificial Sequence
  Description of Artificial Sequence: Synthetic oligonucleotide
ugaaacagcauauucuugaacuu

SEQ ID NO: 285 - DNA, 25 bp, Artificial Sequence
  Description of Artificial Sequence: Synthetic oligonucleotide
  Description of Combined DNA/RNA Molecule: Synthetic oligonucleotide
uucugaacaccucugucuuuuggtt

SEQ ID NO: 286 - RNA, 23 nt, Artificial Sequence
  Description of Artificial Sequence: Synthetic oligonucleotide
uucugaacaccucugucuuuugg

SEQ ID NO: 287 - DNA, 25 bp, Artificial Sequence
  Description of Artificial Sequence: Synthetic oligonucleotide
  Description of Combined DNA/RNA Molecule: Synthetic oligonucleotide
ucucugaacaccucugucuuuugtt

SEQ ID NO: 288 - RNA, 23 nt, Artificial Sequence
  Description of Artificial Sequence: Synthetic oligonucleotide
ucucugaacaccucugucuuuug

SEQ ID NO: 289 - DNA, 25 bp, Artificial Sequence
  Description of Artificial Sequence: Synthetic oligonucleotide
  Description of Combined DNA/RNA Molecule: Synthetic oligonucleotide
ugcaaugucaucuucucuccgggtt

SEQ ID NO: 290 - RNA, 23 nt, Artificial Sequence
  Description of Artificial Sequence: Synthetic oligonucleotide
ugcaaugucaucuucucuccggg

SEQ ID NO: 291 - DNA, 25 bp, Artificial Sequence
  Description of Artificial Sequence: Synthetic oligonucleotide
  Description of Combined DNA/RNA Molecule: Synthetic oligonucleotide
uuuggcaaugucaucuucucucctt

SEQ ID NO: 292 - RNA, 23 nt, Artificial Sequence
  Description of Artificial Sequence: Synthetic oligonucleotide
uuuggcaaugucaucuucucucc

SEQ ID NO: 293 - DNA, 25 bp, Artificial Sequence
  Description of Artificial Sequence: Synthetic oligonucleotide
  Description of Combined DNA/RNA Molecule: Synthetic oligonucleotide
uaccuuggcaaugucaucuucuctt

SEQ ID NO: 294 - RNA, 23 nt, Artificial Sequence
  Description of Artificial Sequence: Synthetic oligonucleotide
uaccuuggcaaugucaucuucuc

SEQ ID NO: 295 - DNA, 25 bp, Artificial Sequence
  Description of Artificial Sequence: Synthetic oligonucleotide
  Description of Combined DNA/RNA Molecule: Synthetic oligonucleotide
uaccauguccuccucagacugactt

SEQ ID NO: 296 - RNA, 23 nt, Artificial Sequence
  Description of Artificial Sequence: Synthetic oligonucleotide
uaccauguccuccucagacugac

SEQ ID NO: 297 - DNA, 25 bp, Artificial Sequence
  Description of Artificial Sequence: Synthetic oligonucleotide
  Description of Combined DNA/RNA Molecule: Synthetic oligonucleotide
aacacaaguaaccuuauccuucgtt

SEQ ID NO: 298 - RNA, 23 nt, Artificial Sequence
  Description of Artificial Sequence: Synthetic oligonucleotide
aacacaaguaaccuuauccuucg

SEQ ID NO: 299 - DNA, 25 bp, Artificial Sequence
  Description of Artificial Sequence: Synthetic oligonucleotide
  Description of Combined DNA/RNA Molecule: Synthetic oligonucleotide
uaacacaaguaaccuuauccuuctt

SEQ ID NO: 300 - RNA, 23 nt, Artificial Sequence
  Description of Artificial Sequence: Synthetic oligonucleotide
uaacacaaguaaccuuauccuuc

SEQ ID NO: 301 - DNA, 25 bp, Artificial Sequence
  Description of Artificial Sequence: Synthetic oligonucleotide
  Description of Combined DNA/RNA Molecule: Synthetic oligonucleotide
aaccacagcaccaaugauaugcctt

SEQ ID NO: 302 - RNA, 23 nt, Artificial Sequence
  Description of Artificial Sequence: Synthetic oligonucleotide
aaccacagcaccaaugauaugcc

SEQ ID NO: 303 - DNA, 25 bp, Artificial Sequence
  Description of Artificial Sequence: Synthetic oligonucleotide
  Description of Combined DNA/RNA Molecule: Synthetic oligonucleotide
uucuucauaggugauuuucaccctt

SEQ ID NO: 304 - RNA, 23 nt, Artificial Sequence
  Description of Artificial Sequence: Synthetic oligonucleotide
uucuucauaggugauuuucaccc

SEQ ID NO: 305 - DNA, 25 bp, Artificial Sequence
  Description of Artificial Sequence: Synthetic oligonucleotide
  Description of Combined DNA/RNA Molecule: Synthetic oligonucleotide
uuuuauagcauccucaauugugatt

SEQ ID NO: 306 - RNA, 23 nt, Artificial Sequence
  Description of Artificial Sequence: Synthetic oligonucleotide
uuuuauagcauccucaauuguga

SEQ ID NO: 307 - DNA, 25 bp, Artificial Sequence
  Description of Artificial Sequence: Synthetic oligonucleotide
  Description of Combined DNA/RNA Molecule: Synthetic oligonucleotide
aaggaguuguucuuuauagcauctt

SEQ ID NO: 308 - RNA, 23 nt, Artificial Sequence
  Description of Artificial Sequence: Synthetic oligonucleotide
aaggaguuguucuuuauagcauc

SEQ ID NO: 309 - DNA, 25 bp, Artificial Sequence
  Description of Artificial Sequence: Synthetic oligonucleotide
  Description of Combined DNA/RNA Molecule: Synthetic oligonucleotide
aaaggaguuguucuuuauagcautt

SEQ ID NO: 310 - RNA, 23 nt, Artificial Sequence
  Description of Artificial Sequence: Synthetic oligonucleotide
aaaggaguuguucuuuauagcau

SEQ ID NO: 311 - DNA, 25 bp, Artificial Sequence
  Description of Artificial Sequence: Synthetic oligonucleotide
  Description of Combined DNA/RNA Molecule: Synthetic oligonucleotide
uaaaaggaguuguucuuuauagctt

SEQ ID NO: 312 - RNA, 23 nt, Artificial Sequence
  Description of Artificial Sequence: Synthetic oligonucleotide
uaaaaggaguuguucuuuauagc

SEQ ID NO: 313 - DNA, 25 bp, Artificial Sequence
  Description of Artificial Sequence: Synthetic oligonucleotide
  Description of Combined DNA/RNA Molecule: Synthetic oligonucleotide
uauaaaaggaguuguucuuuauatt

SEQ ID NO: 314 - RNA, 23 nt, Artificial Sequence
  Description of Artificial Sequence: Synthetic oligonucleotide
uauaaaaggaguuguucuuuaua

SEQ ID NO: 315 - DNA, 25 bp, Artificial Sequence
  Description of Artificial Sequence: Synthetic oligonucleotide
  Description of Combined DNA/RNA Molecule: Synthetic oligonucleotide
uccaccaguuaucagcauguccutt

SEQ ID NO: 316 - RNA, 23 nt, Artificial Sequence
  Description of Artificial Sequence: Synthetic oligonucleotide
uccaccaguuaucagcauguccu

SEQ ID NO: 317 - DNA, 25 bp, Artificial Sequence
  Description of Artificial Sequence: Synthetic oligonucleotide
  Description of Combined DNA/RNA Molecule: Synthetic oligonucleotide
ucugccaccaguuaucagcaugutt

SEQ ID NO: 318 - RNA, 23 nt, Artificial Sequence
  Description of Artificial Sequence: Synthetic oligonucleotide
ucugccaccaguuaucagcaugu

SEQ ID NO: 319 - DNA, 25 bp, Artificial Sequence
  Description of Artificial Sequence: Synthetic oligonucleotide
  Description of Combined DNA/RNA Molecule: Synthetic oligonucleotide
uaugucugccaccaguuaucagctt

SEQ ID NO: 320 - RNA, 23 nt, Artificial Sequence
  Description of Artificial Sequence: Synthetic oligonucleotide
uaugucugccaccaguuaucagc

SEQ ID NO: 321 - DNA, 25 bp, Artificial Sequence
  Description of Artificial Sequence: Synthetic oligonucleotide
  Description of Combined DNA/RNA Molecule: Synthetic oligonucleotide
uuucaugaagccaaccuuguauctt

SEQ ID NO: 322 - RNA, 23 nt, Artificial Sequence
  Description of Artificial Sequence: Synthetic oligonucleotide
uuucaugaagccaaccuuguauc

SEQ ID NO: 323 - DNA, 25 bp, Artificial Sequence
  Description of Artificial Sequence: Synthetic oligonucleotide
  Description of Combined DNA/RNA Molecule: Synthetic oligonucleotide
ucuucaugaagccaaccuuguautt

SEQ ID NO: 324 - RNA, 23 nt, Artificial Sequence
  Description of Artificial Sequence: Synthetic oligonucleotide
ucuucaugaagccaaccuuguau

SEQ ID NO: 325 - DNA, 25 bp, Artificial Sequence
  Description of Artificial Sequence: Synthetic oligonucleotide
  Description of Combined DNA/RNA Molecule: Synthetic oligonucleotide
uaaggugaaacccucaagcuucutt

SEQ ID NO: 326 - RNA, 23 nt, Artificial Sequence
  Description of Artificial Sequence: Synthetic oligonucleotide
uaaggugaaacccucaagcuucu

SEQ ID NO: 327 - DNA, 25 bp, Artificial Sequence
  Description of Artificial Sequence: Synthetic oligonucleotide
  Description of Combined DNA/RNA Molecule: Synthetic oligonucleotide
uaacuugucaaccucacucuucctt

SEQ ID NO: 328 - RNA, 23 nt, Artificial Sequence
  Description of Artificial Sequence: Synthetic oligonucleotide
uaacuugucaaccucacucuucc

SEQ ID NO: 329 - DNA, 25 bp, Artificial Sequence
  Description of Artificial Sequence: Synthetic oligonucleotide
  Description of Combined DNA/RNA Molecule: Synthetic oligonucleotide
uaacaauucuccuuguugaacuutt

SEQ ID NO: 330 - RNA, 23 nt, Artificial Sequence
  Description of Artificial Sequence: Synthetic oligonucleotide
uaacaauucuccuuguugaacuu

SEQ ID NO: 331 - DNA, 25 bp, Artificial Sequence
  Description of Artificial Sequence: Synthetic oligonucleotide
  Description of Combined DNA/RNA Molecule: Synthetic oligonucleotide
uuuuccaacaauucuccuuguugtt

SEQ ID NO: 332 - RNA, 23 nt, Artificial Sequence
  Description of Artificial Sequence: Synthetic oligonucleotide
uuuuccaacaauucuccuuguug

SEQ ID NO: 333 - DNA, 25 bp, Artificial Sequence
  Description of Artificial Sequence: Synthetic oligonucleotide
  Description of Combined DNA/RNA Molecule: Synthetic oligonucleotide
aaagcuuauuccaaacuugguggtt

SEQ ID NO: 334 - RNA, 23 nt, Artificial Sequence
  Description of Artificial Sequence: Synthetic oligonucleotide
aaagcuuauuccaaacuuggugg

SEQ ID NO: 335 - DNA, 25 bp, Artificial Sequence
  Description of Artificial Sequence: Synthetic oligonucleotide
  Description of Combined DNA/RNA Molecule: Synthetic oligonucleotide
ucuuugauggcaaagaagauagatt

SEQ ID NO: 336 - RNA, 23 nt, Artificial Sequence
  Description of Artificial Sequence: Synthetic oligonucleotide
ucuuugauggcaaagaagauaga

SEQ ID NO: 337 - DNA, 25 bp, Artificial Sequence
  Description of Artificial Sequence: Synthetic oligonucleotide
  Description of Combined DNA/RNA Molecule: Synthetic oligonucleotide
uaucuuugauggcaaagaagauatt

SEQ ID NO: 338 - RNA, 23 nt, Artificial Sequence
  Description of Artificial Sequence: Synthetic oligonucleotide
uaucuuugauggcaaagaagaua

SEQ ID NO: 339 - DNA, 25 bp, Artificial Sequence
  Description of Artificial Sequence: Synthetic oligonucleotide
  Description of Combined DNA/RNA Molecule: Synthetic oligonucleotide
uuuuaauagauccauguucugugtt

SEQ ID NO: 340 - RNA, 23 nt, Artificial Sequence
  Description of Artificial Sequence: Synthetic oligonucleotide
uuuuaauagauccauguucugug

SEQ ID NO: 341 - DNA, 25 bp, Artificial Sequence
  Description of Artificial Sequence: Synthetic oligonucleotide
  Description of Combined DNA/RNA Molecule: Synthetic oligonucleotide
uuugaauuugcuuaucauugugutt

SEQ ID NO: 342 - RNA, 23 nt, Artificial Sequence
  Description of Artificial Sequence: Synthetic oligonucleotide
uuugaauuugcuuaucauugugu

SEQ ID NO: 343 - DNA, 25 bp, Artificial Sequence
  Description of Artificial Sequence: Synthetic oligonucleotide
  Description of Combined DNA/RNA Molecule: Synthetic oligonucleotide
ucuaauugcauauucaccauuuatt

SEQ ID NO: 344 - RNA, 23 nt, Artificial Sequence
  Description of Artificial Sequence: Synthetic oligonucleotide
ucuaauugcauauucaccauuua

SEQ ID NO: 345 - DNA, 25 bp, Artificial Sequence
  Description of Artificial Sequence: Synthetic oligonucleotide
  Description of Combined DNA/RNA Molecule: Synthetic oligonucleotide
uaugcuuugcuguucauugguuutt

SEQ ID NO: 346 - RNA, 23 nt, Artificial Sequence
  Description of Artificial Sequence: Synthetic oligonucleotide
uaugcuuugcuguucauugguuu

SEQ ID NO: 347 - DNA, 25 bp, Artificial Sequence
  Description of Artificial Sequence: Synthetic oligonucleotide
  Description of Combined DNA/RNA Molecule: Synthetic oligonucleotide
uuuccaaugauucaaagaugguutt

SEQ ID NO: 348 - RNA, 23 nt, Artificial Sequence
  Description of Artificial Sequence: Synthetic oligonucleotide
uuuccaaugauucaaagaugguu

SEQ ID NO: 349 - DNA, 25 bp, Artificial Sequence
  Description of Artificial Sequence: Synthetic oligonucleotide
  Description of Combined DNA/RNA Molecule: Synthetic oligonucleotide
uuuguuucauucuuuauucuuuctt

SEQ ID NO: 350 - RNA, 23 nt, Artificial Sequence
  Description of Artificial Sequence: Synthetic oligonucleotide
uuuguuucauucuuuauucuuuc

SEQ ID NO: 351 - DNA, 25 bp, Artificial Sequence
  Description of Artificial Sequence: Synthetic oligonucleotide
  Description of Combined DNA/RNA Molecule: Synthetic oligonucleotide
uaauuuguuucauucuuuauucutt

SEQ ID NO: 352 - RNA, 23 nt, Artificial Sequence
  Description of Artificial Sequence: Synthetic oligonucleotide
uaauuuguuucauucuuuauucu

SEQ ID NO: 353 - DNA, 25 bp, Artificial Sequence
  Description of Artificial Sequence: Synthetic oligonucleotide
  Description of Combined DNA/RNA Molecule: Synthetic oligonucleotide
uaauaauugaguugguuggauuutt

SEQ ID NO: 354 - RNA, 23 nt, Artificial Sequence
  Description of Artificial Sequence: Synthetic oligonucleotide
uaauaauugaguugguuggauuu

SEQ ID NO: 355 - DNA, 25 bp, Artificial Sequence
  Description of Artificial Sequence: Synthetic oligonucleotide
  Description of Combined DNA/RNA Molecule: Synthetic oligonucleotide
uaagguuggauuuauacagugaatt

SEQ ID NO: 356 - RNA, 23 nt, Artificial Sequence
  Description of Artificial Sequence: Synthetic oligonucleotide
uaagguuggauuuauacagugaa

SEQ ID NO: 357 - DNA, 25 bp, Artificial Sequence
  Description of Artificial Sequence: Synthetic oligonucleotide
  Description of Combined DNA/RNA Molecule: Synthetic oligonucleotide
uuuccuaugccuuccacaguugutt

SEQ ID NO: 358 - DNA, 25 bp, Artificial Sequence
  Description of Artificial Sequence: Synthetic oligonucleotide
  Description of Combined DNA/RNA Molecule: Synthetic oligonucleotide
ugaucuaaagguuugaaauccuctt

SEQ ID NO: 359 - DNA, 25 bp, Artificial Sequence
  Description of Artificial Sequence: Synthetic oligonucleotide
  Description of Combined DNA/RNA Molecule: Synthetic oligonucleotide
uauuucaaugccuaucucugugutt

SEQ ID NO: 360 - DNA, 25 bp, Artificial Sequence
  Description of Artificial Sequence: Synthetic oligonucleotide
  Description of Combined DNA/RNA Molecule: Synthetic oligonucleotide
uuuaaauuucauuucaaugccuatt

SEQ ID NO: 361 - DNA, 25 bp, Artificial Sequence
  Description of Artificial Sequence: Synthetic oligonucleotide
  Description of Combined DNA/RNA Molecule: Synthetic oligonucleotide
uuuuauagcauccuggauugugatt

SEQ ID NO: 362 - DNA, 25 bp, Artificial Sequence
  Description of Artificial Sequence: Synthetic oligonucleotide
  Description of Combined DNA/RNA Molecule: Synthetic oligonucleotide
aauuucuccacuuccaucuugcgtt

SEQ ID NO: 363 - RNA, 19 nt, Artificial Sequence
  Description of Artificial Sequence: Synthetic oligonucleotide
acuaccugccagugucucu

SEQ ID NO: 364 - RNA, 19 nt, Artificial Sequence
  Description of Artificial Sequence: Synthetic oligonucleotide
uuaggagugagguaccuga

SEQ ID NO: 365 - RNA, 19 nt, Artificial Sequence
  Description of Artificial Sequence: Synthetic oligonucleotide
aaccugugacaaugacaga

SEQ ID NO: 366 - RNA, 19 nt, Artificial Sequence
  Description of Artificial Sequence: Synthetic oligonucleotide
gcagacaaauugguuuucu

SEQ ID NO: 367 - RNA, 19 nt, Artificial Sequence
  Description of Artificial Sequence: Synthetic oligonucleotide
uuugugaauggcagaaaga

SEQ ID NO: 368 - RNA, 19 nt, Artificial Sequence
  Description of Artificial Sequence: Synthetic oligonucleotide
aaggugguggagaaaaaua

SEQ ID NO: 369 - RNA, 19 nt, Artificial Sequence
  Description of Artificial Sequence: Synthetic oligonucleotide
ccuuuuggccuaccugaga

SEQ ID NO: 370 - RNA, 19 nt, Artificial Sequence
  Description of Artificial Sequence: Synthetic oligonucleotide
aagaaaguuggggcugagu

SEQ ID NO: 371 - RNA, 19 nt, Artificial Sequence
  Description of Artificial Sequence: Synthetic oligonucleotide
aguggaaccaagcucggcu

SEQ ID NO: 372 - RNA, 19 nt, Artificial Sequence
  Description of Artificial Sequence: Synthetic oligonucleotide
cuguggagaggggggcuga

SEQ ID NO: 373 - RNA, 19 nt, Artificial Sequence
  Description of Artificial Sequence: Synthetic oligonucleotide
cggggcuugcacagugaua

SEQ ID NO: 374 - RNA, 19 nt, Artificial Sequence
  Description of Artificial Sequence: Synthetic oligonucleotide
augcucuccaaguaugaua

SEQ ID NO: 375 - RNA, 19 nt, Artificial Sequence
  Description of Artificial Sequence: Synthetic oligonucleotide
ucguccacuuuucugccaa

SEQ ID NO: 376 - RNA, 19 nt, Artificial Sequence
  Description of Artificial Sequence: Synthetic oligonucleotide
augccugccuggcccccau

SEQ ID NO: 377 - RNA, 19 nt, Artificial Sequence
  Description of Artificial Sequence: Synthetic oligonucleotide
aucugcuccuugcaccaua

SEQ ID NO: 378 - RNA, 19 nt, Artificial Sequence
  Description of Artificial Sequence: Synthetic oligonucleotide
uguugcagugacaacugua

SEQ ID NO: 379 - RNA, 19 nt, Artificial Sequence
  Description of Artificial Sequence: Synthetic oligonucleotide
uggaaggaauaggaagcaa

SEQ ID NO: 380 - RNA, 19 nt, Artificial Sequence
  Description of Artificial Sequence: Synthetic oligonucleotide
caccaagacgaggcugcau

SEQ ID NO: 381 - RNA, 19 nt, Artificial Sequence
  Description of Artificial Sequence: Synthetic oligonucleotide
uccugugcaggagagaauu

SEQ ID NO: 382 - RNA, 19 nt, Artificial Sequence
  Description of Artificial Sequence: Synthetic oligonucleotide
auugccaaaagccacggcu

SEQ ID NO: 383 - RNA, 19 nt, Artificial Sequence
  Description of Artificial Sequence: Synthetic oligonucleotide
ucccagugcggguucugca

SEQ ID NO: 384 - RNA, 19 nt, Artificial Sequence
  Description of Artificial Sequence: Synthetic oligonucleotide
ugcaccccuggcaucguca

SEQ ID NO: 385 - RNA, 19 nt, Artificial Sequence
  Description of Artificial Sequence: Synthetic oligonucleotide
ugaguauguacacacugcu

SEQ ID NO: 386 - RNA, 19 nt, Artificial Sequence
  Description of Artificial Sequence: Synthetic oligonucleotide
ugcuccggaaucagcccga

SEQ ID NO: 387 - RNA, 19 nt, Artificial Sequence
  Description of Artificial Sequence: Synthetic oligonucleotide
agcccaccauggaggagau

SEQ ID NO: 388 - RNA, 19 nt, Artificial Sequence
  Description of Artificial Sequence: Synthetic oligonucleotide
uugagaaugccuuccaaga

SEQ ID NO: 389 - RNA, 19 nt, Artificial Sequence
  Description of Artificial Sequence: Synthetic oligonucleotide
aaggaaaucugugccgcua

SEQ ID NO: 390 - RNA, 19 nt, Artificial Sequence
  Description of Artificial Sequence: Synthetic oligonucleotide
cacaggcuacagacccaua

SEQ ID NO: 391 - RNA, 19 nt, Artificial Sequence
  Description of Artificial Sequence: Synthetic oligonucleotide
cauccuccagggcuuccga

SEQ ID NO: 392 - RNA, 19 nt, Artificial Sequence
  Description of Artificial Sequence: Synthetic oligonucleotide
accuuugccagggauggua

SEQ ID NO: 393 - RNA, 19 nt, Artificial Sequence
  Description of Artificial Sequence: Synthetic oligonucleotide
uggaugcuguggaggagau

SEQ ID NO: 394 - RNA, 19 nt, Artificial Sequence
  Description of Artificial Sequence: Synthetic oligonucleotide
gaugggaauaauccaaauu

SEQ ID NO: 395 - RNA, 19 nt, Artificial Sequence
  Description of Artificial Sequence: Synthetic oligonucleotide
agaaagaccacucagucaa

SEQ ID NO: 396 - RNA, 19 nt, Artificial Sequence
  Description of Artificial Sequence: Synthetic oligonucleotide
agccucucgccaucuuuau

SEQ ID NO: 397 - RNA, 19 nt, Artificial Sequence
  Description of Artificial Sequence: Synthetic oligonucleotide
uauucaaaccagaggaguu

SEQ ID NO: 398 - RNA, 19 nt, Artificial Sequence
  Description of Artificial Sequence: Synthetic oligonucleotide
uucacgccccuggauccaa

SEQ ID NO: 399 - RNA, 19 nt, Artificial Sequence
  Description of Artificial Sequence: Synthetic oligonucleotide
aacccaggagcccauuuuu

SEQ ID NO: 400 - RNA, 19 nt, Artificial Sequence
  Description of Artificial Sequence: Synthetic oligonucleotide
uucccccagaguugcugaa

SEQ ID NO: 401 - RNA, 19 nt, Artificial Sequence
  Description of Artificial Sequence: Synthetic oligonucleotide
aggcugaaagacacuccua

SEQ ID NO: 402 - RNA, 19 nt, Artificial Sequence
  Description of Artificial Sequence: Synthetic oligonucleotide
ucggaagcagcugcgauuu

SEQ ID NO: 403 - RNA, 19 nt, Artificial Sequence
  Description of Artificial Sequence: Synthetic oligonucleotide
uugaaggggagcgugugaa

SEQ ID NO: 404 - RNA, 19 nt, Artificial Sequence
  Description of Artificial Sequence: Synthetic oligonucleotide
cguggauacaggccucaaa

SEQ ID NO: 405 - RNA, 19 nt, Artificial Sequence
  Description of Artificial Sequence: Synthetic oligonucleotide
aacccucaaggagcugcua

SEQ ID NO: 406 - RNA, 19 nt, Artificial Sequence
  Description of Artificial Sequence: Synthetic oligonucleotide
uggaccucaaggcucagca

SEQ ID NO: 407 - RNA, 19 nt, Artificial Sequence
  Description of Artificial Sequence: Synthetic oligonucleotide
acccugacgccaagcuggu

SEQ ID NO: 408 - RNA, 19 nt, Artificial Sequence
  Description of Artificial Sequence: Synthetic oligonucleotide
ucguggggaacacggagau

SEQ ID NO: 409 - RNA, 19 nt, Artificial Sequence
  Description of Artificial Sequence: Synthetic oligonucleotide
auuggcauugagaugaagu

SEQ ID NO: 410 - RNA, 19 nt, Artificial Sequence
  Description of Artificial Sequence: Synthetic oligonucleotide
aaguucaagaauaugcugu

SEQ ID NO: 411 - RNA, 19 nt, Artificial Sequence
  Description of Artificial Sequence: Synthetic oligonucleotide
uuuccuaugauugucugca

SEQ ID NO: 412 - RNA, 19 nt, Artificial Sequence
  Description of Artificial Sequence: Synthetic oligonucleotide
cccagccuggaucccugaa

SEQ ID NO: 413 - RNA, 19 nt, Artificial Sequence
  Description of Artificial Sequence: Synthetic oligonucleotide
agcugaauucgguagaaca

SEQ ID NO: 414 - RNA, 19 nt, Artificial Sequence
  Description of Artificial Sequence: Synthetic oligonucleotide
cauggacccgacgguaucu

SEQ ID NO: 415 - RNA, 19 nt, Artificial Sequence
  Description of Artificial Sequence: Synthetic oligonucleotide
ucuccuuuggagcugcuua

SEQ ID NO: 416 - RNA, 19 nt, Artificial Sequence
  Description of Artificial Sequence: Synthetic oligonucleotide
ugcccccugagcauuguga

SEQ ID NO: 417 - RNA, 19 nt, Artificial Sequence
  Description of Artificial Sequence: Synthetic oligonucleotide
aaaaaacccugguggauga

SEQ ID NO: 418 - RNA, 19 nt, Artificial Sequence
  Description of Artificial Sequence: Synthetic oligonucleotide
ugcuguugcuaagcuuccu

SEQ ID NO: 419 - RNA, 19 nt, Artificial Sequence
  Description of Artificial Sequence: Synthetic oligonucleotide
ccugcccaaaagacagaga

SEQ ID NO: 420 - RNA, 19 nt, Artificial Sequence
  Description of Artificial Sequence: Synthetic oligonucleotide
uguucagagggguccugga

SEQ ID NO: 421 - RNA, 19 nt, Artificial Sequence
  Description of Artificial Sequence: Synthetic oligonucleotide
uggagcagcugcgcugguu

SEQ ID NO: 422 - RNA, 19 nt, Artificial Sequence
  Description of Artificial Sequence: Synthetic oligonucleotide
uuugcugggaagcaaguca

SEQ ID NO: 423 - RNA, 19 nt, Artificial Sequence
  Description of Artificial Sequence: Synthetic oligonucleotide
caagucuguggcguccguu

SEQ ID NO: 424 - RNA, 19 nt, Artificial Sequence
  Description of Artificial Sequence: Synthetic oligonucleotide
uggagggaacaucaucacu

SEQ ID NO: 425 - RNA, 19 nt, Artificial Sequence
  Description of Artificial Sequence: Synthetic oligonucleotide
ugccagccccaucuccgaa

SEQ ID NO: 426 - RNA, 19 nt, Artificial Sequence
  Description of Artificial Sequence: Synthetic oligonucleotide
accucaaccccguguucau

SEQ ID NO: 427 - RNA, 19 nt, Artificial Sequence
  Description of Artificial Sequence: Synthetic oligonucleotide
ucauggccaguggggccaa

SEQ ID NO: 428 - RNA, 19 nt, Artificial Sequence
  Description of Artificial Sequence: Synthetic oligonucleotide
aagcugacacuugugucca

SEQ ID NO: 429 - RNA, 19 nt, Artificial Sequence
  Description of Artificial Sequence: Synthetic oligonucleotide
cagaggcaccaggagaacu

SEQ ID NO: 430 - RNA, 19 nt, Artificial Sequence
  Description of Artificial Sequence: Synthetic oligonucleotide
uguccagauggaccacaca

SEQ ID NO: 431 - RNA, 19 nt, Artificial Sequence
  Description of Artificial Sequence: Synthetic oligonucleotide
ccuucuucccuggcuacaa

SEQ ID NO: 432 - RNA, 19 nt, Artificial Sequence
  Description of Artificial Sequence: Synthetic oligonucleotide
agaaagacccugcugagca

SEQ ID NO: 433 - RNA, 19 nt, Artificial Sequence
  Description of Artificial Sequence: Synthetic oligonucleotide
ccggaggagauacugcucu

SEQ ID NO: 434 - RNA, 19 nt, Artificial Sequence
  Description of Artificial Sequence: Synthetic oligonucleotide
cucuccauagagauccccu

SEQ ID NO: 435 - RNA, 19 nt, Artificial Sequence
  Description of Artificial Sequence: Synthetic oligonucleotide
uacagcagggagggggagu

SEQ ID NO: 436 - RNA, 19 nt, Artificial Sequence
  Description of Artificial Sequence: Synthetic oligonucleotide
aguauuucucagcauucaa

SEQ ID NO: 437 - RNA, 19 nt, Artificial Sequence
  Description of Artificial Sequence: Synthetic oligonucleotide
aagcaggccucccggagaa

SEQ ID NO: 438 - RNA, 19 nt, Artificial Sequence
  Description of Artificial Sequence: Synthetic oligonucleotide
aagaugacauugccaaggu

SEQ ID NO: 439 - RNA, 19 nt, Artificial Sequence
  Description of Artificial Sequence: Synthetic oligonucleotide
gguaaccaguggcaugaga

SEQ ID NO: 440 - RNA, 19 nt, Artificial Sequence
  Description of Artificial Sequence: Synthetic oligonucleotide
agaguuuuauucaagccaa

SEQ ID NO: 441 - RNA, 19 nt, Artificial Sequence
  Description of Artificial Sequence: Synthetic oligonucleotide
aggaaccacagagguacaa

SEQ ID NO: 442 - RNA, 19 nt, Artificial Sequence
  Description of Artificial Sequence: Synthetic oligonucleotide
aggagcuggcccuuugcua

SEQ ID NO: 443 - RNA, 19 nt, Artificial Sequence
  Description of Artificial Sequence: Synthetic oligonucleotide
uaugguggaauggccaaca

SEQ ID NO: 444 - RNA, 19 nt, Artificial Sequence
  Description of Artificial Sequence: Synthetic oligonucleotide
agaaccaucucagcccuca

SEQ ID NO: 445 - RNA, 19 nt, Artificial Sequence
  Description of Artificial Sequence: Synthetic oligonucleotide
aagaccacucagaggcaga

SEQ ID NO: 446 - RNA, 19 nt, Artificial Sequence
  Description of Artificial Sequence: Synthetic oligonucleotide
cagcuuuccaagcucugga

SEQ ID NO: 447 - RNA, 19 nt, Artificial Sequence
  Description of Artificial Sequence: Synthetic oligonucleotide
aggaggagcugcugcagga

SEQ ID NO: 448 - RNA, 19 nt, Artificial Sequence
  Description of Artificial Sequence: Synthetic oligonucleotide
aggacgugugugcaggacu

SEQ ID NO: 449 - RNA, 19 nt, Artificial Sequence
  Description of Artificial Sequence: Synthetic oligonucleotide
uggcagaggagcugcaucu

SEQ ID NO: 450 - RNA, 19 nt, Artificial Sequence
  Description of Artificial Sequence: Synthetic oligonucleotide
ucugccucccgaugccccu

SEQ ID NO: 451 - RNA, 19 nt, Artificial Sequence
  Description of Artificial Sequence: Synthetic oligonucleotide
gguggcaugguggacuuca

SEQ ID NO: 452 - RNA, 19 nt, Artificial Sequence
  Description of Artificial Sequence: Synthetic oligonucleotide
uuccggugcacccucacca

SEQ ID NO: 453 - RNA, 19 nt, Artificial Sequence
  Description of Artificial Sequence: Synthetic oligonucleotide
ucagcuucuucuucaaguu

SEQ ID NO: 454 - RNA, 19 nt, Artificial Sequence
  Description of Artificial Sequence: Synthetic oligonucleotide
uucuaccugacaguccuua

SEQ ID NO: 455 - RNA, 19 nt, Artificial Sequence
  Description of Artificial Sequence: Synthetic oligonucleotide
gagaaccuggaagacaagu

SEQ ID NO: 456 - RNA, 19 nt, Artificial Sequence
  Description of Artificial Sequence: Synthetic oligonucleotide
ugugguaaacuggacccca

SEQ ID NO: 457 - RNA, 19 nt, Artificial Sequence
  Description of Artificial Sequence: Synthetic oligonucleotide
cacuuucgccagugcaacu

SEQ ID NO: 458 - RNA, 19 nt, Artificial Sequence
  Description of Artificial Sequence: Synthetic oligonucleotide
acuuuacuguuucagaaag

SEQ ID NO: 459 - RNA, 19 nt, Artificial Sequence
  Description of Artificial Sequence: Synthetic oligonucleotide
aagaccccccagccgaugu

SEQ ID NO: 460 - RNA, 19 nt, Artificial Sequence
  Description of Artificial Sequence: Synthetic oligonucleotide
uccagcucuuccaagaggu

SEQ ID NO: 461 - RNA, 19 nt, Artificial Sequence
  Description of Artificial Sequence: Synthetic oligonucleotide
ugcccaagggucagucuga

SEQ ID NO: 462 - RNA, 19 nt, Artificial Sequence
  Description of Artificial Sequence: Synthetic oligonucleotide
gaggaggacauggugggca

SEQ ID NO: 463 - RNA, 19 nt, Artificial Sequence
  Description of Artificial Sequence: Synthetic oligonucleotide
gccggccccugccccaccu

SEQ ID NO: 464 - RNA, 19 nt, Artificial Sequence
  Description of Artificial Sequence: Synthetic oligonucleotide
ccuggcagcggacaugcaa

SEQ ID NO: 465 - RNA, 19 nt, Artificial Sequence
  Description of Artificial Sequence: Synthetic oligonucleotide
aggccucuggugaggccgu

SEQ ID NO: 466 - RNA, 19 nt, Artificial Sequence
  Description of Artificial Sequence: Synthetic oligonucleotide
uguacugugacgacauuca

SEQ ID NO: 467 - RNA, 19 nt, Artificial Sequence
  Description of Artificial Sequence: Synthetic oligonucleotide
cucgcuacgagaaugagcu

SEQ ID NO: 468 - RNA, 19 nt, Artificial Sequence
  Description of Artificial Sequence: Synthetic oligonucleotide
cugucucuccggcugguca

SEQ ID NO: 469 - RNA, 19 nt, Artificial Sequence
  Description of Artificial Sequence: Synthetic oligonucleotide
ccacgccaagaucaaguca

SEQ ID NO: 470 - RNA, 19 nt, Artificial Sequence
  Description of Artificial Sequence: Synthetic oligonucleotide
cauagauacaucagaagcu

SEQ ID NO: 471 - RNA, 19 nt, Artificial Sequence
  Description of Artificial Sequence: Synthetic oligonucleotide
uuuguuuguuucauuucca

SEQ ID NO: 472 - RNA, 19 nt, Artificial Sequence
  Description of Artificial Sequence: Synthetic oligonucleotide
gcugaugauguuccuggga

SEQ ID NO: 473 - RNA, 19 nt, Artificial Sequence
  Description of Artificial Sequence: Synthetic oligonucleotide
cagucuuugcgaaggauaa

SEQ ID NO: 474 - RNA, 19 nt, Artificial Sequence
  Description of Artificial Sequence: Synthetic oligonucleotide
aagguuacuuguguuggga

SEQ ID NO: 475 - RNA, 19 nt, Artificial Sequence
  Description of Artificial Sequence: Synthetic oligonucleotide
cauaucauuggugcuguga

SEQ ID NO: 476 - RNA, 19 nt, Artificial Sequence
  Description of Artificial Sequence: Synthetic oligonucleotide
ugguugcugacaccccgga

SEQ ID NO: 477 - RNA, 19 nt, Artificial Sequence
  Description of Artificial Sequence: Synthetic oligonucleotide
acacacacagagagcugca

SEQ ID NO: 478 - RNA, 19 nt, Artificial Sequence
  Description of Artificial Sequence: Synthetic oligonucleotide
gcccaaggggugaaaauca

SEQ ID NO: 479 - RNA, 19 nt, Artificial Sequence
  Description of Artificial Sequence: Synthetic oligonucleotide
ucaccuaugaagaacuaca

SEQ ID NO: 480 - RNA, 19 nt, Artificial Sequence
  Description of Artificial Sequence: Synthetic oligonucleotide
gaggaugcuauaaagaaca

SEQ ID NO: 481 - RNA, 19 nt, Artificial Sequence
  Description of Artificial Sequence: Synthetic oligonucleotide
caacuccuuuuauggaccu

SEQ ID NO: 482 - RNA, 19 nt, Artificial Sequence
  Description of Artificial Sequence: Synthetic oligonucleotide
ccugagcugaagaucgaga

SEQ ID NO: 483 - RNA, 19 nt, Artificial Sequence
  Description of Artificial Sequence: Synthetic oligonucleotide
aaaggggaccuaaagaaga

SEQ ID NO: 484 - RNA, 19 nt, Artificial Sequence
  Description of Artificial Sequence: Synthetic oligonucleotide
agggguuuuccgaagcaga

SEQ ID NO: 485 - RNA, 19 nt, Artificial Sequence
  Description of Artificial Sequence: Synthetic oligonucleotide
uaauguugugucaggggaa

SEQ ID NO: 486 - RNA, 19 nt, Artificial Sequence
  Description of Artificial Sequence: Synthetic oligonucleotide
agauauacaucgguggcca

SEQ ID NO: 487 - RNA, 19 nt, Artificial Sequence
  Description of Artificial Sequence: Synthetic oligonucleotide
gccaagagcacuucuaccu

SEQ ID NO: 488 - RNA, 19 nt, Artificial Sequence
  Description of Artificial Sequence: Synthetic oligonucleotide
ggagacucacugcaccauu

SEQ ID NO: 489 - RNA, 19 nt, Artificial Sequence
  Description of Artificial Sequence: Synthetic oligonucleotide
uugcuguuccaaaaggcga

SEQ ID NO: 490 - RNA, 19 nt, Artificial Sequence
  Description of Artificial Sequence: Synthetic oligonucleotide
cgaggcaggggagauggaa

SEQ ID NO: 491 - RNA, 19 nt, Artificial Sequence
  Description of Artificial Sequence: Synthetic oligonucleotide
agcucuuugugucuacaca

SEQ ID NO: 492 - RNA, 19 nt, Artificial Sequence
  Description of Artificial Sequence: Synthetic oligonucleotide
cagaacaccaugaagacca

SEQ ID NO: 493 - RNA, 19 nt, Artificial Sequence
  Description of Artificial Sequence: Synthetic oligonucleotide
cagagcuuuguugcaaaaa

SEQ ID NO: 494 - RNA, 19 nt, Artificial Sequence
  Description of Artificial Sequence: Synthetic oligonucleotide
aaaauguuggggguuccaa

SEQ ID NO: 495 - RNA, 19 nt, Artificial Sequence
  Description of Artificial Sequence: Synthetic oligonucleotide
agcaaaccggauugugguu

SEQ ID NO: 496 - RNA, 19 nt, Artificial Sequence
  Description of Artificial Sequence: Synthetic oligonucleotide
uucgagugaagagaaugga

SEQ ID NO: 497 - RNA, 19 nt, Artificial Sequence
  Description of Artificial Sequence: Synthetic oligonucleotide
aggaggcuuuggaggcaaa

SEQ ID NO: 498 - RNA, 19 nt, Artificial Sequence
  Description of Artificial Sequence: Synthetic oligonucleotide
aaggagacccggagcacua

SEQ ID NO: 499 - RNA, 19 nt, Artificial Sequence
  Description of Artificial Sequence: Synthetic oligonucleotide
ugugguguccacggcagua

SEQ ID NO: 500 - RNA, 19 nt, Artificial Sequence
  Description of Artificial Sequence: Synthetic oligonucleotide
uggcccuggcugcauauaa

SEQ ID NO: 501 - RNA, 19 nt, Artificial Sequence
  Description of Artificial Sequence: Synthetic oligonucleotide
ugcgaugcaugcuggacca

SEQ ID NO: 502 - RNA, 19 nt, Artificial Sequence
  Description of Artificial Sequence: Synthetic oligonucleotide
cgugaugaggacaugcuga

SEQ ID NO: 503 - RNA, 19 nt, Artificial Sequence
  Description of Artificial Sequence: Synthetic oligonucleotide
uaacugguggcagacauca

SEQ ID NO: 504 - RNA, 19 nt, Artificial Sequence
  Description of Artificial Sequence: Synthetic oligonucleotide
ucccuuccuggccagauaa

SEQ ID NO: 505 - RNA, 19 nt, Artificial Sequence
  Description of Artificial Sequence: Synthetic oligonucleotide
uacaagguuggcuucauga

SEQ ID NO: 506 - RNA, 19 nt, Artificial Sequence
  Description of Artificial Sequence: Synthetic oligonucleotide
agacugggacaguugugga

SEQ ID NO: 507 - RNA, 19 nt, Artificial Sequence
  Description of Artificial Sequence: Synthetic oligonucleotide
gcucuugagguggaccacu

SEQ ID NO: 508 - RNA, 19 nt, Artificial Sequence
  Description of Artificial Sequence: Synthetic oligonucleotide
acuucagcaauguggggaa

SEQ ID NO: 509 - RNA, 19 nt, Artificial Sequence
  Description of Artificial Sequence: Synthetic oligonucleotide
gaacacccaggaucucucu

SEQ ID NO: 510 - RNA, 19 nt, Artificial Sequence
  Description of Artificial Sequence: Synthetic oligonucleotide
cagaguauuauggaacgaa

SEQ ID NO: 511 - RNA, 19 nt, Artificial Sequence
  Description of Artificial Sequence: Synthetic oligonucleotide
agcuuuauuccacauggaa

SEQ ID NO: 512 - RNA, 19 nt, Artificial Sequence
  Description of Artificial Sequence: Synthetic oligonucleotide
acaacugcuauaaaaucca

SEQ ID NO: 513 - RNA, 19 nt, Artificial Sequence
  Description of Artificial Sequence: Synthetic oligonucleotide
uccccaacauccggggcaa

SEQ ID NO: 514 - RNA, 19 nt, Artificial Sequence
  Description of Artificial Sequence: Synthetic oligonucleotide
ugggcggcugugcaaaaca

SEQ ID NO: 515 - RNA, 19 nt, Artificial Sequence
  Description of Artificial Sequence: Synthetic oligonucleotide
aaccaaccuucccuccaaa

SEQ ID NO: 516 - RNA, 19 nt, Artificial Sequence
  Description of Artificial Sequence: Synthetic oligonucleotide
acacggccuuccggggcuu

SEQ ID NO: 517 - RNA, 19 nt, Artificial Sequence
  Description of Artificial Sequence: Synthetic oligonucleotide
uuggggggccccaggggau

SEQ ID NO: 518 - RNA, 19 nt, Artificial Sequence
  Description of Artificial Sequence: Synthetic oligonucleotide
augcucauugccgagugcu

SEQ ID NO: 519 - RNA, 19 nt, Artificial Sequence
  Description of Artificial Sequence: Synthetic oligonucleotide
uggaugagugaaguugcaa

SEQ ID NO: 520 - RNA, 19 nt, Artificial Sequence
  Description of Artificial Sequence: Synthetic oligonucleotide
agugaccugugggaugccu

SEQ ID NO: 521 - RNA, 19 nt, Artificial Sequence
  Description of Artificial Sequence: Synthetic oligonucleotide
ccugcagaggaggugcgga

SEQ ID NO: 522 - RNA, 19 nt, Artificial Sequence
  Description of Artificial Sequence: Synthetic oligonucleotide
agaaaaaaccuguacaaag

SEQ ID NO: 523 - RNA, 19 nt, Artificial Sequence
  Description of Artificial Sequence: Synthetic oligonucleotide
aaagaaggggaccugacaa

SEQ ID NO: 524 - RNA, 19 nt, Artificial Sequence
  Description of Artificial Sequence: Synthetic oligonucleotide
acacuucaaccagaagcuu

SEQ ID NO: 525 - RNA, 19 nt, Artificial Sequence
  Description of Artificial Sequence: Synthetic oligonucleotide
uugaggguuucaccuugca

SEQ ID NO: 526 - RNA, 19 nt, Artificial Sequence
  Description of Artificial Sequence: Synthetic oligonucleotide
cagaugcugggaagaauga

SEQ ID NO: 527 - RNA, 19 nt, Artificial Sequence
  Description of Artificial Sequence: Synthetic oligonucleotide
ugccuagcaagcucucagu

SEQ ID NO: 528 - RNA, 19 nt, Artificial Sequence
  Description of Artificial Sequence: Synthetic oligonucleotide
uaucaugcucggaagagua

SEQ ID NO: 529 - RNA, 19 nt, Artificial Sequence
  Description of Artificial Sequence: Synthetic oligonucleotide
agugagguugacaaguuca

SEQ ID NO: 530 - RNA, 19 nt, Artificial Sequence
  Description of Artificial Sequence: Synthetic oligonucleotide
aacaaggagaauuguugga

SEQ ID NO: 531 - RNA, 19 nt, Artificial Sequence
  Description of Artificial Sequence: Synthetic oligonucleotide
aaaaagagaggauugugca

SEQ ID NO: 532 - RNA, 19 nt, Artificial Sequence
  Description of Artificial Sequence: Synthetic oligonucleotide
cauaauucccaccaaguuu

SEQ ID NO: 533 - RNA, 19 nt, Artificial Sequence
  Description of Artificial Sequence: Synthetic oligonucleotide
uuuggaauaagcuuuacaa

SEQ ID NO: 534 - RNA, 19 nt, Artificial Sequence
  Description of Artificial Sequence: Synthetic oligonucleotide
aguuccuuuucugaaucaa

SEQ ID NO: 535 - RNA, 19 nt, Artificial Sequence
  Description of Artificial Sequence: Synthetic oligonucleotide
aggcaggagcccuacuuca

SEQ ID NO: 536 - RNA, 19 nt, Artificial Sequence
  Description of Artificial Sequence: Synthetic oligonucleotide
cauguguacacagauggcu

SEQ ID NO: 537 - RNA, 19 nt, Artificial Sequence
  Description of Artificial Sequence: Synthetic oligonucleotide
ucugugcugcugacccaca

SEQ ID NO: 538 - RNA, 19 nt, Artificial Sequence
  Description of Artificial Sequence: Synthetic oligonucleotide
ggccaaggccuucauacca

SEQ ID NO: 539 - RNA, 19 nt, Artificial Sequence
  Description of Artificial Sequence: Synthetic oligonucleotide
aaaaugguccagguggcca

SEQ ID NO: 540 - RNA, 19 nt, Artificial Sequence
  Description of Artificial Sequence: Synthetic oligonucleotide
gccaguagagcucugaaaa

SEQ ID NO: 541 - RNA, 19 nt, Artificial Sequence
  Description of Artificial Sequence: Synthetic oligonucleotide
aauccccaccucuaagauu

SEQ ID NO: 542 - RNA, 19 nt, Artificial Sequence
  Description of Artificial Sequence: Synthetic oligonucleotide
uauaucagcgagacaagca

SEQ ID NO: 543 - RNA, 19 nt, Artificial Sequence
  Description of Artificial Sequence: Synthetic oligonucleotide
agcacuaacacugugccca

SEQ ID NO: 544 - RNA, 19 nt, Artificial Sequence
  Description of Artificial Sequence: Synthetic oligonucleotide
caacaccucucccacggcu

SEQ ID NO: 545 - RNA, 19 nt, Artificial Sequence
  Description of Artificial Sequence: Synthetic oligonucleotide
ugccucugucagcgcugaa

SEQ ID NO: 546 - RNA, 19 nt, Artificial Sequence
  Description of Artificial Sequence: Synthetic oligonucleotide
accucaauggacaggccgu

SEQ ID NO: 547 - RNA, 19 nt, Artificial Sequence
  Description of Artificial Sequence: Synthetic oligonucleotide
gucuaugcggcuugucaga

SEQ ID NO: 548 - RNA, 19 nt, Artificial Sequence
  Description of Artificial Sequence: Synthetic oligonucleotide
agaccaucuugaaaaggcu

SEQ ID NO: 549 - RNA, 19 nt, Artificial Sequence
  Description of Artificial Sequence: Synthetic oligonucleotide
uggaacccuacaagaagaa

SEQ ID NO: 550 - RNA, 19 nt, Artificial Sequence
  Description of Artificial Sequence: Synthetic oligonucleotide
aagaaucccaguggcuccu

SEQ ID NO: 551 - RNA, 19 nt, Artificial Sequence
  Description of Artificial Sequence: Synthetic oligonucleotide
ugggaagacugggucacaa

SEQ ID NO: 552 - RNA, 19 nt, Artificial Sequence
  Description of Artificial Sequence: Synthetic oligonucleotide
acagcugccuacauggaca

SEQ ID NO: 553 - RNA, 19 nt, Artificial Sequence
  Description of Artificial Sequence: Synthetic oligonucleotide
acagugagcuugucugcca

SEQ ID NO: 554 - RNA, 19 nt, Artificial Sequence
  Description of Artificial Sequence: Synthetic oligonucleotide
acuggguuuuauagaacaa

SEQ ID NO: 555 - RNA, 19 nt, Artificial Sequence
  Description of Artificial Sequence: Synthetic oligonucleotide
acccaaucugggcuacaga

SEQ ID NO: 556 - RNA, 19 nt, Artificial Sequence
  Description of Artificial Sequence: Synthetic oligonucleotide
cagcuuugagacuaacuca

SEQ ID NO: 557 - RNA, 19 nt, Artificial Sequence
  Description of Artificial Sequence: Synthetic oligonucleotide
gggaaccccuuccacuacu

SEQ ID NO: 558 - RNA, 19 nt, Artificial Sequence
  Description of Artificial Sequence: Synthetic oligonucleotide
cuucagcuaugggguggcu

SEQ ID NO: 559 - RNA, 19 nt, Artificial Sequence
  Description of Artificial Sequence: Synthetic oligonucleotide
cuugcucugaaguagaaau

SEQ ID NO: 560 - RNA, 19 nt, Artificial Sequence
  Description of Artificial Sequence: Synthetic oligonucleotide
aaaucgacugccuaacaga

SEQ ID NO: 561 - RNA, 19 nt, Artificial Sequence
  Description of Artificial Sequence: Synthetic oligonucleotide
gagaucauaagaaccucca

SEQ ID NO: 562 - RNA, 19 nt, Artificial Sequence
  Description of Artificial Sequence: Synthetic oligonucleotide
gcacagauauugucaugga

SEQ ID NO: 563 - RNA, 19 nt, Artificial Sequence
  Description of Artificial Sequence: Synthetic oligonucleotide
uggauguuggcuccagucu

SEQ ID NO: 564 - RNA, 19 nt, Artificial Sequence
  Description of Artificial Sequence: Synthetic oligonucleotide
uaaacccugccauugauau

SEQ ID NO: 565 - RNA, 19 nt, Artificial Sequence
  Description of Artificial Sequence: Synthetic oligonucleotide
uuggacagguggaagggga

SEQ ID NO: 566 - RNA, 19 nt, Artificial Sequence
  Description of Artificial Sequence: Synthetic oligonucleotide
gggcauuuguccagggccu

SEQ ID NO: 567 - RNA, 19 nt, Artificial Sequence
  Description of Artificial Sequence: Synthetic oligonucleotide
uuggccucuucacccuaga

SEQ ID NO: 568 - RNA, 19 nt, Artificial Sequence
  Description of Artificial Sequence: Synthetic oligonucleotide
agaggagcuacacuauuca

SEQ ID NO: 569 - RNA, 19 nt, Artificial Sequence
  Description of Artificial Sequence: Synthetic oligonucleotide
ccccgaggggagccugcaa

SEQ ID NO: 570 - RNA, 19 nt, Artificial Sequence
  Description of Artificial Sequence: Synthetic oligonucleotide
cacacccguggcccuagca

SEQ ID NO: 571 - RNA, 19 nt, Artificial Sequence
  Description of Artificial Sequence: Synthetic oligonucleotide
accuacaagaucccggcau

SEQ ID NO: 572 - RNA, 19 nt, Artificial Sequence
  Description of Artificial Sequence: Synthetic oligonucleotide
uuuggcagcauccccauua

SEQ ID NO: 573 - RNA, 19 nt, Artificial Sequence
  Description of Artificial Sequence: Synthetic oligonucleotide
ccugcuccgcgacugccca

SEQ ID NO: 574 - RNA, 19 nt, Artificial Sequence
  Description of Artificial Sequence: Synthetic oligonucleotide
caacaagaaggccaucuau

SEQ ID NO: 575 - RNA, 19 nt, Artificial Sequence
  Description of Artificial Sequence: Synthetic oligonucleotide
uaugcaucgaaggcuguua

SEQ ID NO: 576 - RNA, 19 nt, Artificial Sequence
  Description of Artificial Sequence: Synthetic oligonucleotide
uggagagccgccccucuua

SEQ ID NO: 577 - RNA, 19 nt, Artificial Sequence
  Description of Artificial Sequence: Synthetic oligonucleotide
uccuggcugcuucuaucuu

SEQ ID NO: 578 - RNA, 19 nt, Artificial Sequence
  Description of Artificial Sequence: Synthetic oligonucleotide
uucuuugccaucaaagaua

SEQ ID NO: 579 - RNA, 19 nt, Artificial Sequence
  Description of Artificial Sequence: Synthetic oligonucleotide
ccauccgugcagcucgaga

SEQ ID NO: 580 - RNA, 19 nt, Artificial Sequence
  Description of Artificial Sequence: Synthetic oligonucleotide
agcucagcacacagguaau

SEQ ID NO: 581 - RNA, 19 nt, Artificial Sequence
  Description of Artificial Sequence: Synthetic oligonucleotide
aauaacgugaaggaacucu

SEQ ID NO: 582 - RNA, 19 nt, Artificial Sequence
  Description of Artificial Sequence: Synthetic oligonucleotide
uuccggcuagacagcccua

SEQ ID NO: 583 - RNA, 19 nt, Artificial Sequence
  Description of Artificial Sequence: Synthetic oligonucleotide
ugccaccccggagaagaua

SEQ ID NO: 584 - RNA, 19 nt, Artificial Sequence
  Description of Artificial Sequence: Synthetic oligonucleotide
auccgcaaugccugcguga

SEQ ID NO: 585 - RNA, 19 nt, Artificial Sequence
  Description of Artificial Sequence: Synthetic oligonucleotide
gacaaguucaccacccugu

SEQ ID NO: 586 - RNA, 19 nt, Artificial Sequence
  Description of Artificial Sequence: Synthetic oligonucleotide
ugugugucacuggugucca

SEQ ID NO: 587 - RNA, 19 nt, Artificial Sequence
  Description of Artificial Sequence: Synthetic oligonucleotide
agaaaacugcaaacccuga

SEQ ID NO: 588 - RNA, 19 nt, Artificial Sequence
  Description of Artificial Sequence: Synthetic oligonucleotide
cuggucugugagggucuaa

SEQ ID NO: 589 - RNA, 19 nt, Artificial Sequence
  Description of Artificial Sequence: Synthetic oligonucleotide
aaagagagaguccucagca

SEQ ID NO: 590 - RNA, 19 nt, Artificial Sequence
  Description of Artificial Sequence: Synthetic oligonucleotide
agagucuucuugugcugca

SEQ ID NO: 591 - RNA, 19 nt, Artificial Sequence
  Description of Artificial Sequence: Synthetic oligonucleotide
gccuuugggcuuccaugga

SEQ ID NO: 592 - RNA, 19 nt, Artificial Sequence
  Description of Artificial Sequence: Synthetic oligonucleotide
cagaacauggaucuauuaa

SEQ ID NO: 593 - RNA, 19 nt, Artificial Sequence
  Description of Artificial Sequence: Synthetic oligonucleotide
uuaaagucacagaaugaca

SEQ ID NO: 594 - RNA, 19 nt, Artificial Sequence
  Description of Artificial Sequence: Synthetic oligonucleotide
agaccugugauuugucaaa

SEQ ID NO: 595 - RNA, 19 nt, Artificial Sequence
  Description of Artificial Sequence: Synthetic oligonucleotide
agaugggauuuggaagaca

SEQ ID NO: 596 - RNA, 19 nt, Artificial Sequence
  Description of Artificial Sequence: Synthetic oligonucleotide
aagugaaugcaauggaaga

SEQ ID NO: 597 - RNA, 19 nt, Artificial Sequence
  Description of Artificial Sequence: Synthetic oligonucleotide
aagauuuugaucaaaaaua

SEQ ID NO: 598 - RNA, 19 nt, Artificial Sequence
  Description of Artificial Sequence: Synthetic oligonucleotide
uguaauuuguaaacacaau

SEQ ID NO: 599 - RNA, 19 nt, Artificial Sequence
  Description of Artificial Sequence: Synthetic oligonucleotide
gauaagcaaauucaaaacu

SEQ ID NO: 600 - RNA, 19 nt, Artificial Sequence
  Description of Artificial Sequence: Synthetic oligonucleotide
acuguuaugccuaaauggu

SEQ ID NO: 601 - RNA, 19 nt, Artificial Sequence
  Description of Artificial Sequence: Synthetic oligonucleotide
ugaauaugcaauuaggaua

SEQ ID NO: 602 - RNA, 19 nt, Artificial Sequence
  Description of Artificial Sequence: Synthetic oligonucleotide
aucauuuucugucuguuuu

SEQ ID NO: 603 - RNA, 19 nt, Artificial Sequence
  Description of Artificial Sequence: Synthetic oligonucleotide
uuaaucauguaucuggaau

SEQ ID NO: 604 - RNA, 19 nt, Artificial Sequence
  Description of Artificial Sequence: Synthetic oligonucleotide
aauagggucgggaaggguu

SEQ ID NO: 605 - RNA, 19 nt, Artificial Sequence
  Description of Artificial Sequence: Synthetic oligonucleotide
uuugugcuauuccccacuu

SEQ ID NO: 606 - RNA, 19 nt, Artificial Sequence
  Description of Artificial Sequence: Synthetic oligonucleotide
uuacuggacagccuguaua

SEQ ID NO: 607 - RNA, 19 nt, Artificial Sequence
  Description of Artificial Sequence: Synthetic oligonucleotide
aaccucaaguucugauggu

SEQ ID NO: 608 - RNA, 19 nt, Artificial Sequence
  Description of Artificial Sequence: Synthetic oligonucleotide
ugucuguccuuugaagaga

SEQ ID NO: 609 - RNA, 19 nt, Artificial Sequence
  Description of Artificial Sequence: Synthetic oligonucleotide
aggauucccacaaaccucu

SEQ ID NO: 610 - RNA, 19 nt, Artificial Sequence
  Description of Artificial Sequence: Synthetic oligonucleotide
uagaagcuuaaaccgaagu

SEQ ID NO: 611 - RNA, 19 nt, Artificial Sequence
  Description of Artificial Sequence: Synthetic oligonucleotide
aaguuacuuuaaaucgugu

SEQ ID NO: 612 - RNA, 19 nt, Artificial Sequence
  Description of Artificial Sequence: Synthetic oligonucleotide
ugccuuccugugaaagccu

SEQ ID NO: 613 - RNA, 19 nt, Artificial Sequence
  Description of Artificial Sequence: Synthetic oligonucleotide
cuggccuucaaaccaauga

SEQ ID NO: 614 - RNA, 19 nt, Artificial Sequence
  Description of Artificial Sequence: Synthetic oligonucleotide
aacagcaaagcauaaccuu

SEQ ID NO: 615 - RNA, 19 nt, Artificial Sequence
  Description of Artificial Sequence: Synthetic oligonucleotide
uugaaucuauacucaaauu

SEQ ID NO: 616 - RNA, 19 nt, Artificial Sequence
  Description of Artificial Sequence: Synthetic oligonucleotide
uuuugcaaugaggcaguga

SEQ ID NO: 617 - RNA, 19 nt, Artificial Sequence
  Description of Artificial Sequence: Synthetic oligonucleotide
ugggguaagguuaaauccu

SEQ ID NO: 618 - RNA, 19 nt, Artificial Sequence
  Description of Artificial Sequence: Synthetic oligonucleotide
ucuaaccaucuuugaauca

SEQ ID NO: 619 - RNA, 19 nt, Artificial Sequence
  Description of Artificial Sequence: Synthetic oligonucleotide
aucauuggaaagaauaaag

SEQ ID NO: 620 - RNA, 19 nt, Artificial Sequence
  Description of Artificial Sequence: Synthetic oligonucleotide
aaugaaacaaauucaaggu

SEQ ID NO: 621 - RNA, 19 nt, Artificial Sequence
  Description of Artificial Sequence: Synthetic oligonucleotide
agguuaauuggaucugauu

SEQ ID NO: 622 - RNA, 19 nt, Artificial Sequence
  Description of Artificial Sequence: Synthetic oligonucleotide
uuugugaagcugcauaaag

SEQ ID NO: 623 - RNA, 19 nt, Artificial Sequence
  Description of Artificial Sequence: Synthetic oligonucleotide
agcaagauuacucuauaau

SEQ ID NO: 624 - RNA, 19 nt, Artificial Sequence
  Description of Artificial Sequence: Synthetic oligonucleotide
uacaaaaauccaaccaacu

SEQ ID NO: 625 - RNA, 19 nt, Artificial Sequence
  Description of Artificial Sequence: Synthetic oligonucleotide
acucaauuauugagcacgu

SEQ ID NO: 626 - RNA, 19 nt, Artificial Sequence
  Description of Artificial Sequence: Synthetic oligonucleotide
uacaauguucuagauuucu

SEQ ID NO: 627 - RNA, 19 nt, Artificial Sequence
  Description of Artificial Sequence: Synthetic oligonucleotide
uucuuucccuuccucuuua

SEQ ID NO: 628 - RNA, 19 nt, Artificial Sequence
  Description of Artificial Sequence: Synthetic oligonucleotide
gaagagaauauuuguauua

SEQ ID NO: 629 - RNA, 19 nt, Artificial Sequence
  Description of Artificial Sequence: Synthetic oligonucleotide
uuccaaauacucuuugagu

SEQ ID NO: 630 - RNA, 19 nt, Artificial Sequence
  Description of Artificial Sequence: Synthetic oligonucleotide
uauuuacaaaaaagauuau

SEQ ID NO: 631 - RNA, 19 nt, Artificial Sequence
  Description of Artificial Sequence: Synthetic oligonucleotide
uauguuuaaucuuuacauu

SEQ ID NO: 632 - RNA, 19 nt, Artificial Sequence
  Description of Artificial Sequence: Synthetic oligonucleotide
uuugaagccaaaguaauuu

SEQ ID NO: 633 - RNA, 19 nt, Artificial Sequence
  Description of Artificial Sequence: Synthetic oligonucleotide
uuccaccuagaaaugauga

SEQ ID NO: 634 - RNA, 19 nt, Artificial Sequence
  Description of Artificial Sequence: Synthetic oligonucleotide
uaucaguccuggcauggua

SEQ ID NO: 635 - RNA, 19 nt, Artificial Sequence
  Description of Artificial Sequence: Synthetic oligonucleotide
uggcucaccccuauaauca

SEQ ID NO: 636 - RNA, 19 nt, Artificial Sequence
  Description of Artificial Sequence: Synthetic oligonucleotide
aucccagcacuuugggaga

SEQ ID NO: 637 - RNA, 19 nt, Artificial Sequence
  Description of Artificial Sequence: Synthetic oligonucleotide
cuaaggcaggagaauugcu

SEQ ID NO: 638 - RNA, 19 nt, Artificial Sequence
  Description of Artificial Sequence: Synthetic oligonucleotide
ugcuugagcccagcaguuu

SEQ ID NO: 639 - RNA, 19 nt, Artificial Sequence
  Description of Artificial Sequence: Synthetic oligonucleotide
uugagaccagccugggcaa

SEQ ID NO: 640 - RNA, 19 nt, Artificial Sequence
  Description of Artificial Sequence: Synthetic oligonucleotide
acauagagagcuccugucu

SEQ ID NO: 641 - RNA, 19 nt, Artificial Sequence
  Description of Artificial Sequence: Synthetic oligonucleotide
ucuuuaaaaaaaauuuuuu

SEQ ID NO: 642 - RNA, 19 nt, Artificial Sequence
  Description of Artificial Sequence: Synthetic oligonucleotide
uuaauuaguuggucuugau

SEQ ID NO: 643 - RNA, 19 nt, Artificial Sequence
  Description of Artificial Sequence: Synthetic oligonucleotide
uagugcaugccuguaguca

SEQ ID NO: 644 - RNA, 19 nt, Artificial Sequence
  Description of Artificial Sequence: Synthetic oligonucleotide
cccaacuacuugaaaggcu

SEQ ID NO: 645 - RNA, 19 nt, Artificial Sequence
  Description of Artificial Sequence: Synthetic oligonucleotide
cugagguggagagaucauu

SEQ ID NO: 646 - RNA, 19 nt, Artificial Sequence
  Description of Artificial Sequence: Synthetic oligonucleotide
uuugagcucaggagguuga

SEQ ID NO: 647 - RNA, 19 nt, Artificial Sequence
  Description of Artificial Sequence: Synthetic oligonucleotide
uugaggcugcagugagcua

SEQ ID NO: 648 - RNA, 19 nt, Artificial Sequence
  Description of Artificial Sequence: Synthetic oligonucleotide
cuccugccugagcgacuga

SEQ ID NO: 649 - RNA, 19 nt, Artificial Sequence
  Description of Artificial Sequence: Synthetic oligonucleotide
ugagcaagaucuugucucu

SEQ ID NO: 650 - RNA, 19 nt, Artificial Sequence
  Description of Artificial Sequence: Synthetic oligonucleotide
ugaagaaaaaaaaagaaau

SEQ ID NO: 651 - RNA, 19 nt, Artificial Sequence
  Description of Artificial Sequence: Synthetic oligonucleotide
uaaaaaugcugcuaucaaa

SEQ ID NO: 652 - RNA, 19 nt, Artificial Sequence
  Description of Artificial Sequence: Synthetic oligonucleotide
aaaaucaagcccaaccaga

SEQ ID NO: 653 - RNA, 19 nt, Artificial Sequence
  Description of Artificial Sequence: Synthetic oligonucleotide
agagguagaagagccaaga

SEQ ID NO: 654 - RNA, 19 nt, Artificial Sequence
  Description of Artificial Sequence: Synthetic oligonucleotide
aagccuggguucucauccu

SEQ ID NO: 655 - RNA, 19 nt, Artificial Sequence
  Description of Artificial Sequence: Synthetic oligonucleotide
cuagcucugucucuucugu

SEQ ID NO: 656 - RNA, 19 nt, Artificial Sequence
  Description of Artificial Sequence: Synthetic oligonucleotide
uuggacugucaauuccccu

SEQ ID NO: 657 - RNA, 19 nt, Artificial Sequence
  Description of Artificial Sequence: Synthetic oligonucleotide
ccuuccugugauccauuuu

SEQ ID NO: 658 - RNA, 19 nt, Artificial Sequence
  Description of Artificial Sequence: Synthetic oligonucleotide
ucucacgucuucugcuuua

SEQ ID NO: 659 - RNA, 19 nt, Artificial Sequence
  Description of Artificial Sequence: Synthetic oligonucleotide
uaugaccugaaaacuccaa

SEQ ID NO: 660 - RNA, 19 nt, Artificial Sequence
  Description of Artificial Sequence: Synthetic oligonucleotide
uuacauaaaggaucugcaa

SEQ ID NO: 661 - RNA, 19 nt, Artificial Sequence
  Description of Artificial Sequence: Synthetic oligonucleotide
cagcuaucuaaggcuuggu

SEQ ID NO: 662 - RNA, 19 nt, Artificial Sequence
  Description of Artificial Sequence: Synthetic oligonucleotide
augauaccugggucuaaua

SEQ ID NO: 663 - RNA, 19 nt, Artificial Sequence
  Description of Artificial Sequence: Synthetic oligonucleotide
aacucugcugagaucaccu

SEQ ID NO: 664 - RNA, 19 nt, Artificial Sequence
  Description of Artificial Sequence: Synthetic oligonucleotide
accucaaguuucugcgguu

SEQ ID NO: 665 - RNA, 19 nt, Artificial Sequence
  Description of Artificial Sequence: Synthetic oligonucleotide
uugguaaagagaacaagga

SEQ ID NO: 666 - RNA, 19 nt, Artificial Sequence
  Description of Artificial Sequence: Synthetic oligonucleotide
aagaacaaacaucccuuuu

SEQ ID NO: 667 - RNA, 19 nt, Artificial Sequence
  Description of Artificial Sequence: Synthetic oligonucleotide
uuuuauugcuccaaauggu

SEQ ID NO: 668 - RNA, 19 nt, Artificial Sequence
  Description of Artificial Sequence: Synthetic oligonucleotide
gauuuaaucccuacauggu

SEQ ID NO: 669 - RNA, 19 nt, Artificial Sequence
  Description of Artificial Sequence: Synthetic oligonucleotide
ggugcuggguggacaaugu

SEQ ID NO: 670 - RNA, 19 nt, Artificial Sequence
  Description of Artificial Sequence: Synthetic oligonucleotide
ugucacugucacaugccuu

SEQ ID NO: 671 - RNA, 19 nt, Artificial Sequence
  Description of Artificial Sequence: Synthetic oligonucleotide
uucacuguauaaauccaaa

SEQ ID NO: 672 - RNA, 19 nt, Artificial Sequence
  Description of Artificial Sequence: Synthetic oligonucleotide
accuucugccagagagaau

SEQ ID NO: 673 - RNA, 19 nt, Artificial Sequence
  Description of Artificial Sequence: Synthetic oligonucleotide
cauggagggaggauaguga

SEQ ID NO: 674 - RNA, 19 nt, Artificial Sequence
  Description of Artificial Sequence: Synthetic oligonucleotide
aaaugauauaguuggacua

SEQ ID NO: 675 - RNA, 19 nt, Artificial Sequence
  Description of Artificial Sequence: Synthetic oligonucleotide
acuggugcuugaugucacu

SEQ ID NO: 676 - RNA, 19 nt, Artificial Sequence
  Description of Artificial Sequence: Synthetic oligonucleotide
cuaauaaaugaaacuguca

SEQ ID NO: 677 - RNA, 19 nt, Artificial Sequence
  Description of Artificial Sequence: Synthetic oligonucleotide
agagacacuggcagguagu

SEQ ID NO: 678 - RNA, 19 nt, Artificial Sequence
  Description of Artificial Sequence: Synthetic oligonucleotide
ucagguaccucacuccuaa

SEQ ID NO: 679 - RNA, 19 nt, Artificial Sequence
  Description of Artificial Sequence: Synthetic oligonucleotide
ucugucauugucacagguu

SEQ ID NO: 680 - RNA, 19 nt, Artificial Sequence
  Description of Artificial Sequence: Synthetic oligonucleotide
agaaaaccaauuugucugc

SEQ ID NO: 681 - RNA, 19 nt, Artificial Sequence
  Description of Artificial Sequence: Synthetic oligonucleotide
ucuuucugccauucacaaa

SEQ ID NO: 682 - RNA, 19 nt, Artificial Sequence
  Description of Artificial Sequence: Synthetic oligonucleotide
uauuuuucuccaccaccuu

SEQ ID NO: 683 - RNA, 19 nt, Artificial Sequence
  Description of Artificial Sequence: Synthetic oligonucleotide
ucucagguaggccaaaagg

SEQ ID NO: 684 - RNA, 19 nt, Artificial Sequence
  Description of Artificial Sequence: Synthetic oligonucleotide
acucagccccaacuuucuu

SEQ ID NO: 685 - RNA, 19 nt, Artificial Sequence
  Description of Artificial Sequence: Synthetic oligonucleotide
agccgagcuugguuccacu

SEQ ID NO: 686 - RNA, 19 nt, Artificial Sequence
  Description of Artificial Sequence: Synthetic oligonucleotide
ucagccccccucuccacag

SEQ ID NO: 687 - RNA, 19 nt, Artificial Sequence
  Description of Artificial Sequence: Synthetic oligonucleotide
uaucacugugcaagccccg

SEQ ID NO: 688 - RNA, 19 nt, Artificial Sequence
  Description of Artificial Sequence: Synthetic oligonucleotide
uaucauacuuggagagcau

SEQ ID NO: 689 - RNA, 19 nt, Artificial Sequence
  Description of Artificial Sequence: Synthetic oligonucleotide
uuggcagaaaaguggacga

SEQ ID NO: 690 - RNA, 19 nt, Artificial Sequence
  Description of Artificial Sequence: Synthetic oligonucleotide
augggggccaggcaggcau

SEQ ID NO: 691 - RNA, 19 nt, Artificial Sequence
  Description of Artificial Sequence: Synthetic oligonucleotide
uauggugcaaggagcagau

SEQ ID NO: 692 - RNA, 19 nt, Artificial Sequence
  Description of Artificial Sequence: Synthetic oligonucleotide
uacaguugucacugcaaca

SEQ ID NO: 693 - RNA, 19 nt, Artificial Sequence
  Description of Artificial Sequence: Synthetic oligonucleotide
uugcuuccuauuccuucca

SEQ ID NO: 694 - RNA, 19 nt, Artificial Sequence
  Description of Artificial Sequence: Synthetic oligonucleotide
augcagccucgucuuggug

SEQ ID NO: 695 - RNA, 19 nt, Artificial Sequence
  Description of Artificial Sequence: Synthetic oligonucleotide
aauucucuccugcacagga

SEQ ID NO: 696 - RNA, 19 nt, Artificial Sequence
  Description of Artificial Sequence: Synthetic oligonucleotide
agccguggcuuuuggcaau

SEQ ID NO: 697 - RNA, 19 nt, Artificial Sequence
  Description of Artificial Sequence: Synthetic oligonucleotide
ugcagaacccgcacuggga

SEQ ID NO: 698 - RNA, 19 nt, Artificial Sequence
  Description of Artificial Sequence: Synthetic oligonucleotide
ugacgaugccaggggugca

SEQ ID NO: 699 - RNA, 19 nt, Artificial Sequence
  Description of Artificial Sequence: Synthetic oligonucleotide
agcaguguguacauacuca

SEQ ID NO: 700 - RNA, 19 nt, Artificial Sequence
  Description of Artificial Sequence: Synthetic oligonucleotide
ucgggcugauuccggagca

SEQ ID NO: 701 - RNA, 19 nt, Artificial Sequence
  Description of Artificial Sequence: Synthetic oligonucleotide
aucuccuccauggugggcu

SEQ ID NO: 702 - RNA, 19 nt, Artificial Sequence
  Description of Artificial Sequence: Synthetic oligonucleotide
ucuuggaaggcauucucaa

SEQ ID NO: 703 - RNA, 19 nt, Artificial Sequence
  Description of Artificial Sequence: Synthetic oligonucleotide
uagcggcacagauuuccuu

SEQ ID NO: 704 - RNA, 19 nt, Artificial Sequence
  Description of Artificial Sequence: Synthetic oligonucleotide
uaugggucuguagccugug

SEQ ID NO: 705 - RNA, 19 nt, Artificial Sequence
  Description of Artificial Sequence: Synthetic oligonucleotide
ucggaagcccuggaggaug

SEQ ID NO: 706 - RNA, 19 nt, Artificial Sequence
  Description of Artificial Sequence: Synthetic oligonucleotide
uaccaucccuggcaaaggu

SEQ ID NO: 707 - RNA, 19 nt, Artificial Sequence
  Description of Artificial Sequence: Synthetic oligonucleotide
aucuccuccacagcaucca

SEQ ID NO: 708 - RNA, 19 nt, Artificial Sequence
  Description of Artificial Sequence: Synthetic oligonucleotide
aauuuggauuauucccauc

SEQ ID NO: 709 - RNA, 19 nt, Artificial Sequence
  Description of Artificial Sequence: Synthetic oligonucleotide
uugacugaguggucuuucu

SEQ ID NO: 710 - RNA, 19 nt, Artificial Sequence
  Description of Artificial Sequence: Synthetic oligonucleotide
auaaagauggcgagaggcu

SEQ ID NO: 711 - RNA, 19 nt, Artificial Sequence
  Description of Artificial Sequence: Synthetic oligonucleotide
aacuccucugguuugaaua

SEQ ID NO: 712 - RNA, 19 nt, Artificial Sequence
  Description of Artificial Sequence: Synthetic oligonucleotide
uuggauccaggggcgugaa

SEQ ID NO: 713 - RNA, 19 nt, Artificial Sequence
  Description of Artificial Sequence: Synthetic oligonucleotide
aaaaaugggcuccuggguu

SEQ ID NO: 714 - RNA, 19 nt, Artificial Sequence
  Description of Artificial Sequence: Synthetic oligonucleotide
uucagcaacucugggggaa

SEQ ID NO: 715 - RNA, 19 nt, Artificial Sequence
  Description of Artificial Sequence: Synthetic oligonucleotide
uaggagugucuuucagccu

SEQ ID NO: 716 - RNA, 19 nt, Artificial Sequence
  Description of Artificial Sequence: Synthetic oligonucleotide
aaaucgcagcugcuuccga

SEQ ID NO: 717 - RNA, 19 nt, Artificial Sequence
  Description of Artificial Sequence: Synthetic oligonucleotide
uucacacgcuccccuucaa

SEQ ID NO: 718 - RNA, 19 nt, Artificial Sequence
  Description of Artificial Sequence: Synthetic oligonucleotide
uuugaggccuguauccacg

SEQ ID NO: 719 - RNA, 19 nt, Artificial Sequence
  Description of Artificial Sequence: Synthetic oligonucleotide
uagcagcuccuugaggguu

SEQ ID NO: 720 - RNA, 19 nt, Artificial Sequence
  Description of Artificial Sequence: Synthetic oligonucleotide
ugcugagccuugaggucca

SEQ ID NO: 721 - RNA, 19 nt, Artificial Sequence
  Description of Artificial Sequence: Synthetic oligonucleotide
accagcuuggcgucagggu

SEQ ID NO: 722 - RNA, 19 nt, Artificial Sequence
  Description of Artificial Sequence: Synthetic oligonucleotide
aucuccguguuccccacga

SEQ ID NO: 723 - RNA, 19 nt, Artificial Sequence
  Description of Artificial Sequence: Synthetic oligonucleotide
acuucaucucaaugccaau

SEQ ID NO: 724 - RNA, 19 nt, Artificial Sequence
  Description of Artificial Sequence: Synthetic oligonucleotide
acagcauauucuugaacuu

SEQ ID NO: 725 - RNA, 19 nt, Artificial Sequence
  Description of Artificial Sequence: Synthetic oligonucleotide
ugcagacaaucauaggaaa

SEQ ID NO: 726 - RNA, 19 nt, Artificial Sequence
  Description of Artificial Sequence: Synthetic oligonucleotide
uucagggauccaggcuggg

SEQ ID NO: 727 - RNA, 19 nt, Artificial Sequence
  Description of Artificial Sequence: Synthetic oligonucleotide
uguucuaccgaauucagcu

SEQ ID NO: 728 - RNA, 19 nt, Artificial Sequence
  Description of Artificial Sequence: Synthetic oligonucleotide
agauaccgucggguccaug

SEQ ID NO: 729 - RNA, 19 nt, Artificial Sequence
  Description of Artificial Sequence: Synthetic oligonucleotide
uaagcagcuccaaaggaga

SEQ ID NO: 730 - RNA, 19 nt, Artificial Sequence
  Description of Artificial Sequence: Synthetic oligonucleotide
ucacaaugcucagggggca

SEQ ID NO: 731 - RNA, 19 nt, Artificial Sequence
  Description of Artificial Sequence: Synthetic oligonucleotide
ucauccaccaggguuuuuu

SEQ ID NO: 732 - RNA, 19 nt, Artificial Sequence
  Description of Artificial Sequence: Synthetic oligonucleotide
aggaagcuuagcaacagca

SEQ ID NO: 733 - RNA, 19 nt, Artificial Sequence
  Description of Artificial Sequence: Synthetic oligonucleotide
ucucugucuuuugggcagg

SEQ ID NO: 734 - RNA, 19 nt, Artificial Sequence
  Description of Artificial Sequence: Synthetic oligonucleotide
uccaggaccccucugaaca

SEQ ID NO: 735 - RNA, 19 nt, Artificial Sequence
  Description of Artificial Sequence: Synthetic oligonucleotide
aaccagcgcagcugcucca

SEQ ID NO: 736 - RNA, 19 nt, Artificial Sequence
  Description of Artificial Sequence: Synthetic oligonucleotide
ugacuugcuucccagcaaa

SEQ ID NO: 737 - RNA, 19 nt, Artificial Sequence
  Description of Artificial Sequence: Synthetic oligonucleotide
aacggacgccacagacuug

SEQ ID NO: 738 - RNA, 19 nt, Artificial Sequence
  Description of Artificial Sequence: Synthetic oligonucleotide
agugaugauguucccucca

SEQ ID NO: 739 - RNA, 19 nt, Artificial Sequence
  Description of Artificial Sequence: Synthetic oligonucleotide
uucggagauggggcuggca

SEQ ID NO: 740 - RNA, 19 nt, Artificial Sequence
  Description of Artificial Sequence: Synthetic oligonucleotide
augaacacgggguugaggu

SEQ ID NO: 741 - RNA, 19 nt, Artificial Sequence
  Description of Artificial Sequence: Synthetic oligonucleotide
uuggccccacuggccauga

SEQ ID NO: 742 - RNA, 19 nt, Artificial Sequence
  Description of Artificial Sequence: Synthetic oligonucleotide
uggacacaagugucagcuu

SEQ ID NO: 743 - RNA, 19 nt, Artificial Sequence
  Description of Artificial Sequence: Synthetic oligonucleotide
aguucuccuggugccucug

SEQ ID NO: 744 - RNA, 19 nt, Artificial Sequence
  Description of Artificial Sequence: Synthetic oligonucleotide
ugugugguccaucuggaca

SEQ ID NO: 745 - RNA, 19 nt, Artificial Sequence
  Description of Artificial Sequence: Synthetic oligonucleotide
uuguagccagggaagaagg

SEQ ID NO: 746 - RNA, 19 nt, Artificial Sequence
  Description of Artificial Sequence: Synthetic oligonucleotide
ugcucagcagggucuuucu

SEQ ID NO: 747 - RNA, 19 nt, Artificial Sequence
  Description of Artificial Sequence: Synthetic oligonucleotide
agagcaguaucuccuccgg

SEQ ID NO: 748 - RNA, 19 nt, Artificial Sequence
  Description of Artificial Sequence: Synthetic oligonucleotide
aggggaucucuauggagag

SEQ ID NO: 749 - RNA, 19 nt, Artificial Sequence
  Description of Artificial Sequence: Synthetic oligonucleotide
acucccccucccugcugua

SEQ ID NO: 750 - RNA, 19 nt, Artificial Sequence
  Description of Artificial Sequence: Synthetic oligonucleotide
uugaaugcugagaaauacu

SEQ ID NO: 751 - RNA, 19 nt, Artificial Sequence
  Description of Artificial Sequence: Synthetic oligonucleotide
uucuccgggaggccugcuu

SEQ ID NO: 752 - RNA, 19 nt, Artificial Sequence
  Description of Artificial Sequence: Synthetic oligonucleotide
accuuggcaaugucaucuu

SEQ ID NO: 753 - RNA, 19 nt, Artificial Sequence
  Description of Artificial Sequence: Synthetic oligonucleotide
ucucaugccacugguuacc

SEQ ID NO: 754 - RNA, 19 nt, Artificial Sequence
  Description of Artificial Sequence: Synthetic oligonucleotide
uuggcuugaauaaaacucu

SEQ ID NO: 755 - RNA, 19 nt, Artificial Sequence
  Description of Artificial Sequence: Synthetic oligonucleotide
uuguaccucugugguuccu

SEQ ID NO: 756 - RNA, 19 nt, Artificial Sequence
  Description of Artificial Sequence: Synthetic oligonucleotide
uagcaaagggccagcuccu

SEQ ID NO: 757 - RNA, 19 nt, Artificial Sequence
  Description of Artificial Sequence: Synthetic oligonucleotide
uguuggccauuccaccaua

SEQ ID NO: 758 - RNA, 19 nt, Artificial Sequence
  Description of Artificial Sequence: Synthetic oligonucleotide
ugagggcugagaugguucu

SEQ ID NO: 759 - RNA, 19 nt, Artificial Sequence
  Description of Artificial Sequence: Synthetic oligonucleotide
ucugccucugaguggucuu

SEQ ID NO: 760 - RNA, 19 nt, Artificial Sequence
  Description of Artificial Sequence: Synthetic oligonucleotide
uccagagcuuggaaagcug

SEQ ID NO: 761 - RNA, 19 nt, Artificial Sequence
  Description of Artificial Sequence: Synthetic oligonucleotide
uccugcagcagcuccuccu

SEQ ID NO: 762 - RNA, 19 nt, Artificial Sequence
  Description of Artificial Sequence: Synthetic oligonucleotide
aguccugcacacacguccu

SEQ ID NO: 763 - RNA, 19 nt, Artificial Sequence
  Description of Artificial Sequence: Synthetic oligonucleotide
agaugcagcuccucugcca

SEQ ID NO: 764 - RNA, 19 nt, Artificial Sequence
  Description of Artificial Sequence: Synthetic oligonucleotide
aggggcaucgggaggcaga

SEQ ID NO: 765 - RNA, 19 nt, Artificial Sequence
  Description of Artificial Sequence: Synthetic oligonucleotide
ugaaguccaccaugccacc

SEQ ID NO: 766 - RNA, 19 nt, Artificial Sequence
  Description of Artificial Sequence: Synthetic oligonucleotide
uggugagggugcaccggaa

SEQ ID NO: 767 - RNA, 19 nt, Artificial Sequence
  Description of Artificial Sequence: Synthetic oligonucleotide
aacuugaagaagaagcuga

SEQ ID NO: 768 - RNA, 19 nt, Artificial Sequence
  Description of Artificial Sequence: Synthetic oligonucleotide
uaaggacugucagguagaa

SEQ ID NO: 769 - RNA, 19 nt, Artificial Sequence
  Description of Artificial Sequence: Synthetic oligonucleotide
acuugucuuccagguucuc

SEQ ID NO: 770 - RNA, 19 nt, Artificial Sequence
  Description of Artificial Sequence: Synthetic oligonucleotide
ugggguccaguuuaccaca

SEQ ID NO: 771 - RNA, 19 nt, Artificial Sequence
  Description of Artificial Sequence: Synthetic oligonucleotide
aguugcacuggcgaaagug

SEQ ID NO: 772 - RNA, 19 nt, Artificial Sequence
  Description of Artificial Sequence: Synthetic oligonucleotide
cuuucugaaacaguaaagu

SEQ ID NO: 773 - RNA, 19 nt, Artificial Sequence
  Description of Artificial Sequence: Synthetic oligonucleotide
acaucggcuggggggucuu

SEQ ID NO: 774 - RNA, 19 nt, Artificial Sequence
  Description of Artificial Sequence: Synthetic oligonucleotide
accucuuggaagagcugga

SEQ ID NO: 775 - RNA, 19 nt, Artificial Sequence
  Description of Artificial Sequence: Synthetic oligonucleotide
ucagacugacccuugggca

SEQ ID NO: 776 - RNA, 19 nt, Artificial Sequence
  Description of Artificial Sequence: Synthetic oligonucleotide
ugcccaccauguccuccuc

SEQ ID NO: 777 - RNA, 19 nt, Artificial Sequence
  Description of Artificial Sequence: Synthetic oligonucleotide
agguggggcaggggccggc

SEQ ID NO: 778 - RNA, 19 nt, Artificial Sequence
  Description of Artificial Sequence: Synthetic oligonucleotide
uugcauguccgcugccagg

SEQ ID NO: 779 - RNA, 19 nt, Artificial Sequence
  Description of Artificial Sequence: Synthetic oligonucleotide
acggccucaccagaggccu

SEQ ID NO: 780 - RNA, 19 nt, Artificial Sequence
  Description of Artificial Sequence: Synthetic oligonucleotide
ugaaugucgucacaguaca

SEQ ID NO: 781 - RNA, 19 nt, Artificial Sequence
  Description of Artificial Sequence: Synthetic oligonucleotide
agcucauucucguagcgag

SEQ ID NO: 782 - RNA, 19 nt, Artificial Sequence
  Description of Artificial Sequence: Synthetic oligonucleotide
ugaccagccggagagacag

SEQ ID NO: 783 - RNA, 19 nt, Artificial Sequence
  Description of Artificial Sequence: Synthetic oligonucleotide
ugacuugaucuuggcgugg

SEQ ID NO: 784 - RNA, 19 nt, Artificial Sequence
  Description of Artificial Sequence: Synthetic oligonucleotide
agcuucugauguaucuaug

SEQ ID NO: 785 - RNA, 19 nt, Artificial Sequence
  Description of Artificial Sequence: Synthetic oligonucleotide
uggaaaugaaacaaacaaa

SEQ ID NO: 786 - RNA, 19 nt, Artificial Sequence
  Description of Artificial Sequence: Synthetic oligonucleotide
ucccaggaacaucaucagc

SEQ ID NO: 787 - RNA, 19 nt, Artificial Sequence
  Description of Artificial Sequence: Synthetic oligonucleotide
uuauccuucgcaaagacug

SEQ ID NO: 788 - RNA, 19 nt, Artificial Sequence
  Description of Artificial Sequence: Synthetic oligonucleotide
ucccaacacaaguaaccuu

SEQ ID NO: 789 - RNA, 19 nt, Artificial Sequence
  Description of Artificial Sequence: Synthetic oligonucleotide
ucacagcaccaaugauaug

SEQ ID NO: 790 - RNA, 19 nt, Artificial Sequence
  Description of Artificial Sequence: Synthetic oligonucleotide
uccggggugucagcaacca

SEQ ID NO: 791 - RNA, 19 nt, Artificial Sequence
  Description of Artificial Sequence: Synthetic oligonucleotide
ugcagcucucugugugugu

SEQ ID NO: 792 - RNA, 19 nt, Artificial Sequence
  Description of Artificial Sequence: Synthetic oligonucleotide
ugauuuucaccccuugggc

SEQ ID NO: 793 - RNA, 19 nt, Artificial Sequence
  Description of Artificial Sequence: Synthetic oligonucleotide
uguaguucuucauagguga

SEQ ID NO: 794 - RNA, 19 nt, Artificial Sequence
  Description of Artificial Sequence: Synthetic oligonucleotide
uguucuuuauagcauccuc

SEQ ID NO: 795 - RNA, 19 nt, Artificial Sequence
  Description of Artificial Sequence: Synthetic oligonucleotide
agguccauaaaaggaguug

SEQ ID NO: 796 - RNA, 19 nt, Artificial Sequence
  Description of Artificial Sequence: Synthetic oligonucleotide
ucucgaucuucagcucagg

SEQ ID NO: 797 - RNA, 19 nt, Artificial Sequence
  Description of Artificial Sequence: Synthetic oligonucleotide
ucuucuuuagguccccuuu

SEQ ID NO: 798 - RNA, 19 nt, Artificial Sequence
  Description of Artificial Sequence: Synthetic oligonucleotide
ucugcuucggaaaaccccu

SEQ ID NO: 799 - RNA, 19 nt, Artificial Sequence
  Description of Artificial Sequence: Synthetic oligonucleotide
uuccccugacacaacauua

SEQ ID NO: 800 - RNA, 19 nt, Artificial Sequence
  Description of Artificial Sequence: Synthetic oligonucleotide
uggccaccgauguauaucu

SEQ ID NO: 801 - RNA, 19 nt, Artificial Sequence
  Description of Artificial Sequence: Synthetic oligonucleotide
agguagaagugcucuuggc

SEQ ID NO: 802 - RNA, 19 nt, Artificial Sequence
  Description of Artificial Sequence: Synthetic oligonucleotide
aauggugcagugagucucc

SEQ ID NO: 803 - RNA, 19 nt, Artificial Sequence
  Description of Artificial Sequence: Synthetic oligonucleotide
ucgccuuuuggaacagcaa

SEQ ID NO: 804 - RNA, 19 nt, Artificial Sequence
  Description of Artificial Sequence: Synthetic oligonucleotide
uuccaucuccccugccucg

SEQ ID NO: 805 - RNA, 19 nt, Artificial Sequence
  Description of Artificial Sequence: Synthetic oligonucleotide
uguguagacacaaagagcu

SEQ ID NO: 806 - RNA, 19 nt, Artificial Sequence
  Description of Artificial Sequence: Synthetic oligonucleotide
uggucuucaugguguucug

SEQ ID NO: 807 - RNA, 19 nt, Artificial Sequence
  Description of Artificial Sequence: Synthetic oligonucleotide
uuuuugcaacaaagcucug

SEQ ID NO: 808 - RNA, 19 nt, Artificial Sequence
  Description of Artificial Sequence: Synthetic oligonucleotide
uuggaacccccaacauuuu

SEQ ID NO: 809 - RNA, 19 nt, Artificial Sequence
  Description of Artificial Sequence: Synthetic oligonucleotide
aaccacaauccgguuugcu

SEQ ID NO: 810 - RNA, 19 nt, Artificial Sequence
  Description of Artificial Sequence: Synthetic oligonucleotide
uccauucucuucacucgaa

SEQ ID NO: 811 - RNA, 19 nt, Artificial Sequence
  Description of Artificial Sequence: Synthetic oligonucleotide
uuugccuccaaagccuccu

SEQ ID NO: 812 - RNA, 19 nt, Artificial Sequence
  Description of Artificial Sequence: Synthetic oligonucleotide
uagugcuccgggucuccuu

SEQ ID NO: 813 - RNA, 19 nt, Artificial Sequence
  Description of Artificial Sequence: Synthetic oligonucleotide
uacugccguggacaccaca

SEQ ID NO: 814 - RNA, 19 nt, Artificial Sequence
  Description of Artificial Sequence: Synthetic oligonucleotide
uuauaugcagccagggcca

SEQ ID NO: 815 - RNA, 19 nt, Artificial Sequence
  Description of Artificial Sequence: Synthetic oligonucleotide
ugguccagcaugcaucgca

SEQ ID NO: 816 - RNA, 19 nt, Artificial Sequence
  Description of Artificial Sequence: Synthetic oligonucleotide
ucagcauguccucaucacg

SEQ ID NO: 817 - RNA, 19 nt, Artificial Sequence
  Description of Artificial Sequence: Synthetic oligonucleotide
ugaugucugccaccaguua

SEQ ID NO: 818 - RNA, 19 nt, Artificial Sequence
  Description of Artificial Sequence: Synthetic oligonucleotide
uuaucuggccaggaaggga

SEQ ID NO: 819 - RNA, 19 nt, Artificial Sequence
  Description of Artificial Sequence: Synthetic oligonucleotide
ucaugaagccaaccuugua

SEQ ID NO: 820 - RNA, 19 nt, Artificial Sequence
  Description of Artificial Sequence: Synthetic oligonucleotide
uccacaacugucccagucu

SEQ ID NO: 821 - RNA, 19 nt, Artificial Sequence
  Description of Artificial Sequence: Synthetic oligonucleotide
agugguccaccucaagagc

SEQ ID NO: 822 - RNA, 19 nt, Artificial Sequence
  Description of Artificial Sequence: Synthetic oligonucleotide
uuccccacauugcugaagu

SEQ ID NO: 823 - RNA, 19 nt, Artificial Sequence
  Description of Artificial Sequence: Synthetic oligonucleotide
agagagauccuggguguuc

SEQ ID NO: 824 - RNA, 19 nt, Artificial Sequence
  Description of Artificial Sequence: Synthetic oligonucleotide
uucguuccauaauacucug

SEQ ID NO: 825 - RNA, 19 nt, Artificial Sequence
  Description of Artificial Sequence: Synthetic oligonucleotide
uuccauguggaauaaagcu

SEQ ID NO: 826 - RNA, 19 nt, Artificial Sequence
  Description of Artificial Sequence: Synthetic oligonucleotide
uggauuuuauagcaguugu

SEQ ID NO: 827 - RNA, 19 nt, Artificial Sequence
  Description of Artificial Sequence: Synthetic oligonucleotide
uugccccggauguugggga

SEQ ID NO: 828 - RNA, 19 nt, Artificial Sequence
  Description of Artificial Sequence: Synthetic oligonucleotide
uguuuugcacagccgccca

SEQ ID NO: 829 - RNA, 19 nt, Artificial Sequence
  Description of Artificial Sequence: Synthetic oligonucleotide
uuuggagggaagguugguu

SEQ ID NO: 830 - RNA, 19 nt, Artificial Sequence
  Description of Artificial Sequence: Synthetic oligonucleotide
aagccccggaaggccgugu

SEQ ID NO: 831 - RNA, 19 nt, Artificial Sequence
  Description of Artificial Sequence: Synthetic oligonucleotide
auccccuggggccccccaa

SEQ ID NO: 832 - RNA, 19 nt, Artificial Sequence
  Description of Artificial Sequence: Synthetic oligonucleotide
agcacucggcaaugagcau

SEQ ID NO: 833 - RNA, 19 nt, Artificial Sequence
  Description of Artificial Sequence: Synthetic oligonucleotide
uugcaacuucacucaucca

SEQ ID NO: 834 - RNA, 19 nt, Artificial Sequence
  Description of Artificial Sequence: Synthetic oligonucleotide
aggcaucccacaggucacu

SEQ ID NO: 835 - RNA, 19 nt, Artificial Sequence
  Description of Artificial Sequence: Synthetic oligonucleotide
uccgcaccuccucugcagg

SEQ ID NO: 836 - RNA, 19 nt, Artificial Sequence
  Description of Artificial Sequence: Synthetic oligonucleotide
cuuuguacagguuuuuucu

SEQ ID NO: 837 - RNA, 19 nt, Artificial Sequence
  Description of Artificial Sequence: Synthetic oligonucleotide
uugucagguccccuucuuu

SEQ ID NO: 838 - RNA, 19 nt, Artificial Sequence
  Description of Artificial Sequence: Synthetic oligonucleotide
aagcuucugguugaagugu

SEQ ID NO: 839 - RNA, 19 nt, Artificial Sequence
  Description of Artificial Sequence: Synthetic oligonucleotide
ugcaaggugaaacccucaa

SEQ ID NO: 840 - RNA, 19 nt, Artificial Sequence
  Description of Artificial Sequence: Synthetic oligonucleotide
ucauucuucccagcaucug

SEQ ID NO: 841 - RNA, 19 nt, Artificial Sequence
  Description of Artificial Sequence: Synthetic oligonucleotide
acugagagcuugcuaggca

SEQ ID NO: 842 - RNA, 19 nt, Artificial Sequence
  Description of Artificial Sequence: Synthetic oligonucleotide
uacucuuccgagcaugaua

SEQ ID NO: 843 - RNA, 19 nt, Artificial Sequence
  Description of Artificial Sequence: Synthetic oligonucleotide
ugaacuugucaaccucacu

SEQ ID NO: 844 - RNA, 19 nt, Artificial Sequence
  Description of Artificial Sequence: Synthetic oligonucleotide
uccaacaauucuccuuguu

SEQ ID NO: 845 - RNA, 19 nt, Artificial Sequence
  Description of Artificial Sequence: Synthetic oligonucleotide
ugcacaauccucucuuuuu

SEQ ID NO: 846 - RNA, 19 nt, Artificial Sequence
  Description of Artificial Sequence: Synthetic oligonucleotide
aaacuuggugggaauuaug

SEQ ID NO: 847 - RNA, 19 nt, Artificial Sequence
  Description of Artificial Sequence: Synthetic oligonucleotide
uuguaaagcuuauuccaaa

SEQ ID NO: 848 - RNA, 19 nt, Artificial Sequence
  Description of Artificial Sequence: Synthetic oligonucleotide
uugauucagaaaaggaacu

SEQ ID NO: 849 - RNA, 19 nt, Artificial Sequence
  Description of Artificial Sequence: Synthetic oligonucleotide
ugaaguagggcuccugccu

SEQ ID NO: 850 - RNA, 19 nt, Artificial Sequence
  Description of Artificial Sequence: Synthetic oligonucleotide
agccaucuguguacacaug

SEQ ID NO: 851 - RNA, 19 nt, Artificial Sequence
  Description of Artificial Sequence: Synthetic oligonucleotide
ugugggucagcagcacaga

SEQ ID NO: 852 - RNA, 19 nt, Artificial Sequence
  Description of Artificial Sequence: Synthetic oligonucleotide
ugguaugaaggccuuggcc

SEQ ID NO: 853 - RNA, 19 nt, Artificial Sequence
  Description of Artificial Sequence: Synthetic oligonucleotide
uggccaccuggaccauuuu

SEQ ID NO: 854 - RNA, 19 nt, Artificial Sequence
  Description of Artificial Sequence: Synthetic oligonucleotide
uuuucagagcucuacuggc

SEQ ID NO: 855 - RNA, 19 nt, Artificial Sequence
  Description of Artificial Sequence: Synthetic oligonucleotide
aaucuuagagguggggauu

SEQ ID NO: 856 - RNA, 19 nt, Artificial Sequence
  Description of Artificial Sequence: Synthetic oligonucleotide
ugcuugucucgcugauaua

SEQ ID NO: 857 - RNA, 19 nt, Artificial Sequence
  Description of Artificial Sequence: Synthetic oligonucleotide
ugggcacaguguuagugcu

SEQ ID NO: 858 - RNA, 19 nt, Artificial Sequence
  Description of Artificial Sequence: Synthetic oligonucleotide
agccgugggagagguguug

SEQ ID NO: 859 - RNA, 19 nt, Artificial Sequence
  Description of Artificial Sequence: Synthetic oligonucleotide
uucagcgcugacagaggca

SEQ ID NO: 860 - RNA, 19 nt, Artificial Sequence
  Description of Artificial Sequence: Synthetic oligonucleotide
acggccuguccauugaggu

SEQ ID NO: 861 - RNA, 19 nt, Artificial Sequence
  Description of Artificial Sequence: Synthetic oligonucleotide
ucugacaagccgcauagac

SEQ ID NO: 862 - RNA, 19 nt, Artificial Sequence
  Description of Artificial Sequence: Synthetic oligonucleotide
agccuuuucaagauggucu

SEQ ID NO: 863 - RNA, 19 nt, Artificial Sequence
  Description of Artificial Sequence: Synthetic oligonucleotide
uucuucuuguaggguucca

SEQ ID NO: 864 - RNA, 19 nt, Artificial Sequence
  Description of Artificial Sequence: Synthetic oligonucleotide
aggagccacugggauucuu

SEQ ID NO: 865 - RNA, 19 nt, Artificial Sequence
  Description of Artificial Sequence: Synthetic oligonucleotide
uugugacccagucuuccca

SEQ ID NO: 866 - RNA, 19 nt, Artificial Sequence
  Description of Artificial Sequence: Synthetic oligonucleotide
uguccauguaggcagcugu

SEQ ID NO: 867 - RNA, 19 nt, Artificial Sequence
  Description of Artificial Sequence: Synthetic oligonucleotide
uggcagacaagcucacugu

SEQ ID NO: 868 - RNA, 19 nt, Artificial Sequence
  Description of Artificial Sequence: Synthetic oligonucleotide
uuguucuauaaaacccagu

SEQ ID NO: 869 - RNA, 19 nt, Artificial Sequence
  Description of Artificial Sequence: Synthetic oligonucleotide
ucuguagcccagauugggu

SEQ ID NO: 870 - RNA, 19 nt, Artificial Sequence
  Description of Artificial Sequence: Synthetic oligonucleotide
ugaguuagucucaaagcug

SEQ ID NO: 871 - RNA, 19 nt, Artificial Sequence
  Description of Artificial Sequence: Synthetic oligonucleotide
aguaguggaagggguuccc

SEQ ID NO: 872 - RNA, 19 nt, Artificial Sequence
  Description of Artificial Sequence: Synthetic oligonucleotide
agccaccccauagcugaag

SEQ ID NO: 873 - RNA, 19 nt, Artificial Sequence
  Description of Artificial Sequence: Synthetic oligonucleotide
auuucuacuucagagcaag

SEQ ID NO: 874 - RNA, 19 nt, Artificial Sequence
  Description of Artificial Sequence: Synthetic oligonucleotide
ucuguuaggcagucgauuu

SEQ ID NO: 875 - RNA, 19 nt, Artificial Sequence
  Description of Artificial Sequence: Synthetic oligonucleotide
uggagguucuuaugaucuc

SEQ ID NO: 876 - RNA, 19 nt, Artificial Sequence
  Description of Artificial Sequence: Synthetic oligonucleotide
uccaugacaauaucugugc

SEQ ID NO: 877 - RNA, 19 nt, Artificial Sequence
  Description of Artificial Sequence: Synthetic oligonucleotide
agacuggagccaacaucca

SEQ ID NO: 878 - RNA, 19 nt, Artificial Sequence
  Description of Artificial Sequence: Synthetic oligonucleotide
auaucaauggcaggguuua

SEQ ID NO: 879 - RNA, 19 nt, Artificial Sequence
  Description of Artificial Sequence: Synthetic oligonucleotide
uccccuuccaccuguccaa

SEQ ID NO: 880 - RNA, 19 nt, Artificial Sequence
  Description of Artificial Sequence: Synthetic oligonucleotide
aggcccuggacaaaugccc

SEQ ID NO: 881 - RNA, 19 nt, Artificial Sequence
  Description of Artificial Sequence: Synthetic oligonucleotide
ucuagggugaagaggccaa

SEQ ID NO: 882 - RNA, 19 nt, Artificial Sequence
  Description of Artificial Sequence: Synthetic oligonucleotide
ugaauaguguagcuccucu

SEQ ID NO: 883 - RNA, 19 nt, Artificial Sequence
  Description of Artificial Sequence: Synthetic oligonucleotide
uugcaggcuccccucgggg

SEQ ID NO: 884 - RNA, 19 nt, Artificial Sequence
  Description of Artificial Sequence: Synthetic oligonucleotide
ugcuagggccacgggugug

SEQ ID NO: 885 - RNA, 19 nt, Artificial Sequence
  Description of Artificial Sequence: Synthetic oligonucleotide
augccgggaucuuguaggu

SEQ ID NO: 886 - RNA, 19 nt, Artificial Sequence
  Description of Artificial Sequence: Synthetic oligonucleotide
uaauggggaugcugccaaa

SEQ ID NO: 887 - RNA, 19 nt, Artificial Sequence
  Description of Artificial Sequence: Synthetic oligonucleotide
ugggcagucgcggagcagg

SEQ ID NO: 888 - RNA, 19 nt, Artificial Sequence
  Description of Artificial Sequence: Synthetic oligonucleotide
auagauggccuucuuguug

SEQ ID NO: 889 - RNA, 19 nt, Artificial Sequence
  Description of Artificial Sequence: Synthetic oligonucleotide
uaacagccuucgaugcaua

SEQ ID NO: 890 - RNA, 19 nt, Artificial Sequence
  Description of Artificial Sequence: Synthetic oligonucleotide
uaagaggggcggcucucca

SEQ ID NO: 891 - RNA, 19 nt, Artificial Sequence
  Description of Artificial Sequence: Synthetic oligonucleotide
aagauagaagcagccagga

SEQ ID NO: 892 - RNA, 19 nt, Artificial Sequence
  Description of Artificial Sequence: Synthetic oligonucleotide
uaucuuugauggcaaagaa

SEQ ID NO: 893 - RNA, 19 nt, Artificial Sequence
  Description of Artificial Sequence: Synthetic oligonucleotide
ucucgagcugcacggaugg

SEQ ID NO: 894 - RNA, 19 nt, Artificial Sequence
  Description of Artificial Sequence: Synthetic oligonucleotide
auuaccugugugcugagcu

SEQ ID NO: 895 - RNA, 19 nt, Artificial Sequence
  Description of Artificial Sequence: Synthetic oligonucleotide
agaguuccuucacguuauu

SEQ ID NO: 896 - RNA, 19 nt, Artificial Sequence
  Description of Artificial Sequence: Synthetic oligonucleotide
uagggcugucuagccggaa

SEQ ID NO: 897 - RNA, 19 nt, Artificial Sequence
  Description of Artificial Sequence: Synthetic oligonucleotide
uaucuucuccgggguggca

SEQ ID NO: 898 - RNA, 19 nt, Artificial Sequence
  Description of Artificial Sequence: Synthetic oligonucleotide
ucacgcaggcauugcggau

SEQ ID NO: 899 - RNA, 19 nt, Artificial Sequence
  Description of Artificial Sequence: Synthetic oligonucleotide
acaggguggugaacuuguc

SEQ ID NO: 900 - RNA, 19 nt, Artificial Sequence
  Description of Artificial Sequence: Synthetic oligonucleotide
uggacaccagugacacaca

SEQ ID NO: 901 - RNA, 19 nt, Artificial Sequence
  Description of Artificial Sequence: Synthetic oligonucleotide
ucaggguuugcaguuuucu

SEQ ID NO: 902 - RNA, 19 nt, Artificial Sequence
  Description of Artificial Sequence: Synthetic oligonucleotide
uuagacccucacagaccag

SEQ ID NO: 903 - RNA, 19 nt, Artificial Sequence
  Description of Artificial Sequence: Synthetic oligonucleotide
ugcugaggacucucucuuu

SEQ ID NO: 904 - RNA, 19 nt, Artificial Sequence
  Description of Artificial Sequence: Synthetic oligonucleotide
ugcagcacaagaagacucu

SEQ ID NO: 905 - RNA, 19 nt, Artificial Sequence
  Description of Artificial Sequence: Synthetic oligonucleotide
uccauggaagcccaaaggc

SEQ ID NO: 906 - RNA, 19 nt, Artificial Sequence
  Description of Artificial Sequence: Synthetic oligonucleotide
uuaauagauccauguucug

SEQ ID NO: 907 - RNA, 19 nt, Artificial Sequence
  Description of Artificial Sequence: Synthetic oligonucleotide
ugucauucugugacuuuaa

SEQ ID NO: 908 - RNA, 19 nt, Artificial Sequence
  Description of Artificial Sequence: Synthetic oligonucleotide
uuugacaaaucacaggucu

SEQ ID NO: 909 - RNA, 19 nt, Artificial Sequence
  Description of Artificial Sequence: Synthetic oligonucleotide
ugucuuccaaaucccaucu

SEQ ID NO: 910 - RNA, 19 nt, Artificial Sequence
  Description of Artificial Sequence: Synthetic oligonucleotide
ucuuccauugcauucacuu

SEQ ID NO: 911 - RNA, 19 nt, Artificial Sequence
  Description of Artificial Sequence: Synthetic oligonucleotide
uauuuuugaucaaaaucuu

SEQ ID NO: 912 - RNA, 19 nt, Artificial Sequence
  Description of Artificial Sequence: Synthetic oligonucleotide
auuguguuuacaaauuaca

SEQ ID NO: 913 - RNA, 19 nt, Artificial Sequence
  Description of Artificial Sequence: Synthetic oligonucleotide
aguuuugaauuugcuuauc

SEQ ID NO: 914 - RNA, 19 nt, Artificial Sequence
  Description of Artificial Sequence: Synthetic oligonucleotide
accauuuaggcauaacagu

SEQ ID NO: 915 - RNA, 19 nt, Artificial Sequence
  Description of Artificial Sequence: Synthetic oligonucleotide
uauccuaauugcauauuca

SEQ ID NO: 916 - RNA, 19 nt, Artificial Sequence
  Description of Artificial Sequence: Synthetic oligonucleotide
aaaacagacagaaaaugau

SEQ ID NO: 917 - RNA, 19 nt, Artificial Sequence
  Description of Artificial Sequence: Synthetic oligonucleotide
auuccagauacaugauuaa

SEQ ID NO: 918 - RNA, 19 nt, Artificial Sequence
  Description of Artificial Sequence: Synthetic oligonucleotide
aacccuucccgacccuauu

SEQ ID NO: 919 - RNA, 19 nt, Artificial Sequence
  Description of Artificial Sequence: Synthetic oligonucleotide
aaguggggaauagcacaaa

SEQ ID NO: 920 - RNA, 19 nt, Artificial Sequence
  Description of Artificial Sequence: Synthetic oligonucleotide
uauacaggcuguccaguaa

SEQ ID NO: 921 - RNA, 19 nt, Artificial Sequence
  Description of Artificial Sequence: Synthetic oligonucleotide
accaucagaacuugagguu

SEQ ID NO: 922 - RNA, 19 nt, Artificial Sequence
  Description of Artificial Sequence: Synthetic oligonucleotide
ucucuucaaaggacagaca

SEQ ID NO: 923 - RNA, 19 nt, Artificial Sequence
  Description of Artificial Sequence: Synthetic oligonucleotide
agagguuugugggaauccu

SEQ ID NO: 924 - RNA, 19 nt, Artificial Sequence
  Description of Artificial Sequence: Synthetic oligonucleotide
acuucgguuuaagcuucua

SEQ ID NO: 925 - RNA, 19 nt, Artificial Sequence
  Description of Artificial Sequence: Synthetic oligonucleotide
acacgauuuaaaguaacuu

SEQ ID NO: 926 - RNA, 19 nt, Artificial Sequence
  Description of Artificial Sequence: Synthetic oligonucleotide
aggcuuucacaggaaggca

SEQ ID NO: 927 - RNA, 19 nt, Artificial Sequence
  Description of Artificial Sequence: Synthetic oligonucleotide
ucauugguuugaaggccag

SEQ ID NO: 928 - RNA, 19 nt, Artificial Sequence
  Description of Artificial Sequence: Synthetic oligonucleotide
aagguuaugcuuugcuguu

SEQ ID NO: 929 - RNA, 19 nt, Artificial Sequence
  Description of Artificial Sequence: Synthetic oligonucleotide
aauuugaguauagauucaa

SEQ ID NO: 930 - RNA, 19 nt, Artificial Sequence
  Description of Artificial Sequence: Synthetic oligonucleotide
ucacugccucauugcaaaa

SEQ ID NO: 931 - RNA, 19 nt, Artificial Sequence
  Description of Artificial Sequence: Synthetic oligonucleotide
aggauuuaaccuuacccca

SEQ ID NO: 932 - RNA, 19 nt, Artificial Sequence
  Description of Artificial Sequence: Synthetic oligonucleotide
ugauucaaagaugguuaga

SEQ ID NO: 933 - RNA, 19 nt, Artificial Sequence
  Description of Artificial Sequence: Synthetic oligonucleotide
cuuuauucuuuccaaugau

SEQ ID NO: 934 - RNA, 19 nt, Artificial Sequence
  Description of Artificial Sequence: Synthetic oligonucleotide
accuugaauuuguuucauu

SEQ ID NO: 935 - RNA, 19 nt, Artificial Sequence
  Description of Artificial Sequence: Synthetic oligonucleotide
aaucagauccaauuaaccu

SEQ ID NO: 936 - RNA, 19 nt, Artificial Sequence
  Description of Artificial Sequence: Synthetic oligonucleotide
cuuuaugcagcuucacaaa

SEQ ID NO: 937 - RNA, 19 nt, Artificial Sequence
  Description of Artificial Sequence: Synthetic oligonucleotide
auuauagaguaaucuugcu

SEQ ID NO: 938 - RNA, 19 nt, Artificial Sequence
  Description of Artificial Sequence: Synthetic oligonucleotide
aguugguuggauuuuugua

SEQ ID NO: 939 - RNA, 19 nt, Artificial Sequence
  Description of Artificial Sequence: Synthetic oligonucleotide
acgugcucaauaauugagu

SEQ ID NO: 940 - RNA, 19 nt, Artificial Sequence
  Description of Artificial Sequence: Synthetic oligonucleotide
agaaaucuagaacauugua

SEQ ID NO: 941 - RNA, 19 nt, Artificial Sequence
  Description of Artificial Sequence: Synthetic oligonucleotide
uaaagaggaagggaaagaa

SEQ ID NO: 942 - RNA, 19 nt, Artificial Sequence
  Description of Artificial Sequence: Synthetic oligonucleotide
uaauacaaauauucucuuc

SEQ ID NO: 943 - RNA, 19 nt, Artificial Sequence
  Description of Artificial Sequence: Synthetic oligonucleotide
acucaaagaguauuuggaa

SEQ ID NO: 944 - RNA, 19 nt, Artificial Sequence
  Description of Artificial Sequence: Synthetic oligonucleotide
auaaucuuuuuuguaaaua

SEQ ID NO: 945 - RNA, 19 nt, Artificial Sequence
  Description of Artificial Sequence: Synthetic oligonucleotide
aauguaaagauuaaacaua

SEQ ID NO: 946 - RNA, 19 nt, Artificial Sequence
  Description of Artificial Sequence: Synthetic oligonucleotide
aaauuacuuuggcuucaaa

SEQ ID NO: 947 - RNA, 19 nt, Artificial Sequence
  Description of Artificial Sequence: Synthetic oligonucleotide
ucaucauuucuagguggaa

SEQ ID NO: 948 - RNA, 19 nt, Artificial Sequence
  Description of Artificial Sequence: Synthetic oligonucleotide
uaccaugccaggacugaua

SEQ ID NO: 949 - RNA, 19 nt, Artificial Sequence
  Description of Artificial Sequence: Synthetic oligonucleotide
ugauuauaggggugagcca

SEQ ID NO: 950 - RNA, 19 nt, Artificial Sequence
  Description of Artificial Sequence: Synthetic oligonucleotide
ucucccaaagugcugggau

SEQ ID NO: 951 - RNA, 19 nt, Artificial Sequence
  Description of Artificial Sequence: Synthetic oligonucleotide
agcaauucuccugccuuag

SEQ ID NO: 952 - RNA, 19 nt, Artificial Sequence
  Description of Artificial Sequence: Synthetic oligonucleotide
aaacugcugggcucaagca

SEQ ID NO: 953 - RNA, 19 nt, Artificial Sequence
  Description of Artificial Sequence: Synthetic oligonucleotide
uugcccaggcuggucucaa

SEQ ID NO: 954 - RNA, 19 nt, Artificial Sequence
  Description of Artificial Sequence: Synthetic oligonucleotide
agacaggagcucucuaugu

SEQ ID NO: 955 - RNA, 19 nt, Artificial Sequence
  Description of Artificial Sequence: Synthetic oligonucleotide
aaaaaauuuuuuuuaaaga

SEQ ID NO: 956 - RNA, 19 nt, Artificial Sequence
  Description of Artificial Sequence: Synthetic oligonucleotide
aucaagaccaacuaauuaa

SEQ ID NO: 957 - RNA, 19 nt, Artificial Sequence
  Description of Artificial Sequence: Synthetic oligonucleotide
ugacuacaggcaugcacua

SEQ ID NO: 958 - RNA, 19 nt, Artificial Sequence
  Description of Artificial Sequence: Synthetic oligonucleotide
agccuuucaaguaguuggg

SEQ ID NO: 959 - RNA, 19 nt, Artificial Sequence
  Description of Artificial Sequence: Synthetic oligonucleotide
aaugaucucuccaccucag

SEQ ID NO: 960 - RNA, 19 nt, Artificial Sequence
  Description of Artificial Sequence: Synthetic oligonucleotide
ucaaccuccugagcucaaa

SEQ ID NO: 961 - RNA, 19 nt, Artificial Sequence
  Description of Artificial Sequence: Synthetic oligonucleotide
uagcucacugcagccucaa

SEQ ID NO: 962 - RNA, 19 nt, Artificial Sequence
  Description of Artificial Sequence: Synthetic oligonucleotide
ucagucgcucaggcaggag

SEQ ID NO: 963 - RNA, 19 nt, Artificial Sequence
  Description of Artificial Sequence: Synthetic oligonucleotide
agagacaagaucuugcuca

SEQ ID NO: 964 - RNA, 19 nt, Artificial Sequence
  Description of Artificial Sequence: Synthetic oligonucleotide
auuucuuuuuuuuucuuca

SEQ ID NO: 965 - RNA, 19 nt, Artificial Sequence
  Description of Artificial Sequence: Synthetic oligonucleotide
uuugauagcagcauuuuua

SEQ ID NO: 966 - RNA, 19 nt, Artificial Sequence
  Description of Artificial Sequence: Synthetic oligonucleotide
ucugguugggcuugauuuu

SEQ ID NO: 967 - RNA, 19 nt, Artificial Sequence
  Description of Artificial Sequence: Synthetic oligonucleotide
ucuuggcucuucuaccucu

SEQ ID NO: 968 - RNA, 19 nt, Artificial Sequence
  Description of Artificial Sequence: Synthetic oligonucleotide
aggaugagaacccaggcuu

SEQ ID NO: 969 - RNA, 19 nt, Artificial Sequence
  Description of Artificial Sequence: Synthetic oligonucleotide
acagaagagacagagcuag

SEQ ID NO: 970 - RNA, 19 nt, Artificial Sequence
  Description of Artificial Sequence: Synthetic oligonucleotide
aggggaauugacaguccaa

SEQ ID NO: 971 - RNA, 19 nt, Artificial Sequence
  Description of Artificial Sequence: Synthetic oligonucleotide
aaaauggaucacaggaagg

SEQ ID NO: 972 - RNA, 19 nt, Artificial Sequence
  Description of Artificial Sequence: Synthetic oligonucleotide
uaaagcagaagacgugaga

SEQ ID NO: 973 - RNA, 19 nt, Artificial Sequence
  Description of Artificial Sequence: Synthetic oligonucleotide
uuggaguuuucaggucaua

SEQ ID NO: 974 - RNA, 19 nt, Artificial Sequence
  Description of Artificial Sequence: Synthetic oligonucleotide
uugcagauccuuuauguaa

SEQ ID NO: 975 - RNA, 19 nt, Artificial Sequence
  Description of Artificial Sequence: Synthetic oligonucleotide
accaagccuuagauagcug

SEQ ID NO: 976 - RNA, 19 nt, Artificial Sequence
  Description of Artificial Sequence: Synthetic oligonucleotide
uauuagacccagguaucau

SEQ ID NO: 977 - RNA, 19 nt, Artificial Sequence
  Description of Artificial Sequence: Synthetic oligonucleotide
aggugaucucagcagaguu

SEQ ID NO: 978 - RNA, 19 nt, Artificial Sequence
  Description of Artificial Sequence: Synthetic oligonucleotide
aaccgcagaaacuugaggu

SEQ ID NO: 979 - RNA, 19 nt, Artificial Sequence
  Description of Artificial Sequence: Synthetic oligonucleotide
uccuuguucucuuuaccaa

SEQ ID NO: 980 - RNA, 19 nt, Artificial Sequence
  Description of Artificial Sequence: Synthetic oligonucleotide
aaaagggauguuuguucuu

SEQ ID NO: 981 - RNA, 19 nt, Artificial Sequence
  Description of Artificial Sequence: Synthetic oligonucleotide
accauuuggagcaauaaaa

SEQ ID NO: 982 - RNA, 19 nt, Artificial Sequence
  Description of Artificial Sequence: Synthetic oligonucleotide
accauguagggauuaaauc

SEQ ID NO: 983 - RNA, 19 nt, Artificial Sequence
  Description of Artificial Sequence: Synthetic oligonucleotide
acauuguccacccagcacc

SEQ ID NO: 984 - RNA, 19 nt, Artificial Sequence
  Description of Artificial Sequence: Synthetic oligonucleotide
aaggcaugugacagugaca

SEQ ID NO: 985 - RNA, 19 nt, Artificial Sequence
  Description of Artificial Sequence: Synthetic oligonucleotide
uuuggauuuauacagugaa

SEQ ID NO: 986 - RNA, 19 nt, Artificial Sequence
  Description of Artificial Sequence: Synthetic oligonucleotide
auucucucuggcagaaggu

SEQ ID NO: 987 - RNA, 19 nt, Artificial Sequence
  Description of Artificial Sequence: Synthetic oligonucleotide
ucacuauccucccuccaug

SEQ ID NO: 988 - RNA, 19 nt, Artificial Sequence
  Description of Artificial Sequence: Synthetic oligonucleotide
uaguccaacuauaucauuu

SEQ ID NO: 989 - RNA, 19 nt, Artificial Sequence
  Description of Artificial Sequence: Synthetic oligonucleotide
agugacaucaagcaccagu

SEQ ID NO: 990 - RNA, 19 nt, Artificial Sequence
  Description of Artificial Sequence: Synthetic oligonucleotide
ugacaguuucauuuauuag

SEQ ID NO: 991 - DNA, 21 bp, Artificial Sequence
  Description of Artificial Sequence: Synthetic oligonucleotide
  Description of Combined DNA/RNA Molecule: Synthetic oligonucleotide
acuaccugccagugucucutt

SEQ ID NO: 992 - DNA, 21 bp, Artificial Sequence
  Description of Artificial Sequence: Synthetic oligonucleotide
  Description of Combined DNA/RNA Molecule: Synthetic oligonucleotide
uuaggagugagguaccugatt

SEQ ID NO: 993 - DNA, 21 bp, Artificial Sequence
  Description of Artificial Sequence: Synthetic oligonucleotide
  Description of Combined DNA/RNA Molecule: Synthetic oligonucleotide
aaccugugacaaugacagatt

SEQ ID NO: 994 - DNA, 21 bp, Artificial Sequence
  Description of Artificial Sequence: Synthetic oligonucleotide
  Description of Combined DNA/RNA Molecule: Synthetic oligonucleotide
gcagacaaauugguuuucutt

SEQ ID NO: 995 - DNA, 21 bp, Artificial Sequence
  Description of Artificial Sequence: Synthetic oligonucleotide
  Description of Combined DNA/RNA Molecule: Synthetic oligonucleotide
uuugugaauggcagaaagatt

SEQ ID NO: 996 - DNA, 21 bp, Artificial Sequence
  Description of Artificial Sequence: Synthetic oligonucleotide
  Description of Combined DNA/RNA Molecule: Synthetic oligonucleotide
aaggugguggagaaaaauatt

SEQ ID NO: 997 - DNA, 21 bp, Artificial Sequence
  Description of Artificial Sequence: Synthetic oligonucleotide
  Description of Combined DNA/RNA Molecule: Synthetic oligonucleotide
ccuuuuggccuaccugagatt

SEQ ID NO: 998 - DNA, 21 bp, Artificial Sequence
  Description of Artificial Sequence: Synthetic oligonucleotide
  Description of Combined DNA/RNA Molecule: Synthetic oligonucleotide
aagaaaguuggggcugagutt

SEQ ID NO: 999 - DNA, 21 bp, Artificial Sequence
  Description of Artificial Sequence: Synthetic oligonucleotide
  Description of Combined DNA/RNA Molecule: Synthetic oligonucleotide
aguggaaccaagcucggcutt

SEQ ID NO: 1000 - DNA, 21 bp, Artificial Sequence
  Description of Artificial Sequence: Synthetic oligonucleotide
  Description of Combined DNA/RNA Molecule: Synthetic oligonucleotide
cuguggagaggggggcugatt

SEQ ID NO: 1001 - DNA, 21 bp, Artificial Sequence
  Description of Artificial Sequence: Synthetic oligonucleotide
  Description of Combined DNA/RNA Molecule: Synthetic oligonucleotide
cggggcuugcacagugauatt

SEQ ID NO: 1002 - DNA, 21 bp, Artificial Sequence
  Description of Artificial Sequence: Synthetic oligonucleotide
  Description of Combined DNA/RNA Molecule: Synthetic oligonucleotide
augcucuccaaguaugauatt

SEQ ID NO: 1003 - DNA, 21 bp, Artificial Sequence
  Description of Artificial Sequence: Synthetic oligonucleotide
  Description of Combined DNA/RNA Molecule: Synthetic oligonucleotide
ucguccacuuuucugccaatt

SEQ ID NO: 1004 - DNA, 21 bp, Artificial Sequence
  Description of Artificial Sequence: Synthetic oligonucleotide
  Description of Combined DNA/RNA Molecule: Synthetic oligonucleotide
augccugccuggcccccautt

SEQ ID NO: 1005 - DNA, 21 bp, Artificial Sequence
  Description of Artificial Sequence: Synthetic oligonucleotide
  Description of Combined DNA/RNA Molecule: Synthetic oligonucleotide
aucugcuccuugcaccauatt

SEQ ID NO: 1006 - DNA, 21 bp, Artificial Sequence
  Description of Artificial Sequence: Synthetic oligonucleotide
  Description of Combined DNA/RNA Molecule: Synthetic oligonucleotide
uguugcagugacaacuguatt

SEQ ID NO: 1007 - DNA, 21 bp, Artificial Sequence
  Description of Artificial Sequence: Synthetic oligonucleotide
  Description of Combined DNA/RNA Molecule: Synthetic oligonucleotide
uggaaggaauaggaagcaatt

SEQ ID NO: 1008 - DNA, 21 bp, Artificial Sequence
  Description of Artificial Sequence: Synthetic oligonucleotide
  Description of Combined DNA/RNA Molecule: Synthetic oligonucleotide
caccaagacgaggcugcautt

SEQ ID NO: 1009 - DNA, 21 bp, Artificial Sequence
  Description of Artificial Sequence: Synthetic oligonucleotide
  Description of Combined DNA/RNA Molecule: Synthetic oligonucleotide
uccugugcaggagagaauutt

SEQ ID NO: 1010 - DNA, 21 bp, Artificial Sequence
  Description of Artificial Sequence: Synthetic oligonucleotide
  Description of Combined DNA/RNA Molecule: Synthetic oligonucleotide
auugccaaaagccacggcutt

SEQ ID NO: 1011 - DNA, 21 bp, Artificial Sequence
  Description of Artificial Sequence: Synthetic oligonucleotide
  Description of Combined DNA/RNA Molecule: Synthetic oligonucleotide
ucccagugcggguucugcatt

SEQ ID NO: 1012 - DNA, 21 bp, Artificial Sequence
  Description of Artificial Sequence: Synthetic oligonucleotide
  Description of Combined DNA/RNA Molecule: Synthetic oligonucleotide
ugcaccccuggcaucgucatt

SEQ ID NO: 1013 - DNA, 21 bp, Artificial Sequence
  Description of Artificial Sequence: Synthetic oligonucleotide
  Description of Combined DNA/RNA Molecule: Synthetic oligonucleotide
ugaguauguacacacugcutt

SEQ ID NO: 1014 - DNA, 21 bp, Artificial Sequence
  Description of Artificial Sequence: Synthetic oligonucleotide
  Description of Combined DNA/RNA Molecule: Synthetic oligonucleotide
ugcuccggaaucagcccgatt

SEQ ID NO: 1015 - DNA, 21 bp, Artificial Sequence
  Description of Artificial Sequence: Synthetic oligonucleotide
  Description of Combined DNA/RNA Molecule: Synthetic oligonucleotide
agcccaccauggaggagautt

SEQ ID NO: 1016 - DNA, 21 bp, Artificial Sequence
  Description of Artificial Sequence: Synthetic oligonucleotide
  Description of Combined DNA/RNA Molecule: Synthetic oligonucleotide
uugagaaugccuuccaagatt

SEQ ID NO: 1017 - DNA, 21 bp, Artificial Sequence
  Description of Artificial Sequence: Synthetic oligonucleotide
  Description of Combined DNA/RNA Molecule: Synthetic oligonucleotide
aaggaaaucugugccgcuatt

SEQ ID NO: 1018 - DNA, 21 bp, Artificial Sequence
  Description of Artificial Sequence: Synthetic oligonucleotide
  Description of Combined DNA/RNA Molecule: Synthetic oligonucleotide
cacaggcuacagacccauatt

SEQ ID NO: 1019 - DNA, 21 bp, Artificial Sequence
  Description of Artificial Sequence: Synthetic oligonucleotide
  Description of Combined DNA/RNA Molecule: Synthetic oligonucleotide
cauccuccagggcuuccgatt

SEQ ID NO: 1020 - DNA, 21 bp, Artificial Sequence
  Description of Artificial Sequence: Synthetic oligonucleotide
  Description of Combined DNA/RNA Molecule: Synthetic oligonucleotide
accuuugccagggaugguatt

SEQ ID NO: 1021 - DNA, 21 bp, Artificial Sequence
  Description of Artificial Sequence: Synthetic oligonucleotide
  Description of Combined DNA/RNA Molecule: Synthetic oligonucleotide
uggaugcuguggaggagautt

SEQ ID NO: 1022 - DNA, 21 bp, Artificial Sequence
  Description of Artificial Sequence: Synthetic oligonucleotide
  Description of Combined DNA/RNA Molecule: Synthetic oligonucleotide
gaugggaauaauccaaauutt

SEQ ID NO: 1023 - DNA, 21 bp, Artificial Sequence
  Description of Artificial Sequence: Synthetic oligonucleotide
  Description of Combined DNA/RNA Molecule: Synthetic oligonucleotide
agaaagaccacucagucaatt

SEQ ID NO: 1024 - DNA, 21 bp, Artificial Sequence
  Description of Artificial Sequence: Synthetic oligonucleotide
  Description of Combined DNA/RNA Molecule: Synthetic oligonucleotide
agccucucgccaucuuuautt

SEQ ID NO: 1025 - DNA, 21 bp, Artificial Sequence
  Description of Artificial Sequence: Synthetic oligonucleotide
  Description of Combined DNA/RNA Molecule: Synthetic oligonucleotide
uauucaaaccagaggaguutt

SEQ ID NO: 1026 - DNA, 21 bp, Artificial Sequence
  Description of Artificial Sequence: Synthetic oligonucleotide
  Description of Combined DNA/RNA Molecule: Synthetic oligonucleotide
uucacgccccuggauccaatt

SEQ ID NO: 1027 - DNA, 21 bp, Artificial Sequence
  Description of Artificial Sequence: Synthetic oligonucleotide
  Description of Combined DNA/RNA Molecule: Synthetic oligonucleotide
aacccaggagcccauuuuutt

SEQ ID NO: 1028 - DNA, 21 bp, Artificial Sequence
  Description of Artificial Sequence: Synthetic oligonucleotide
  Description of Combined DNA/RNA Molecule: Synthetic oligonucleotide
uucccccagaguugcugaatt

SEQ ID NO: 1029 - DNA, 21 bp, Artificial Sequence
  Description of Artificial Sequence: Synthetic oligonucleotide
  Description of Combined DNA/RNA Molecule: Synthetic oligonucleotide
aggcugaaagacacuccuatt

SEQ ID NO: 1030 - DNA, 21 bp, Artificial Sequence
  Description of Artificial Sequence: Synthetic oligonucleotide
  Description of Combined DNA/RNA Molecule: Synthetic oligonucleotide
ucggaagcagcugcgauuutt

SEQ ID NO: 1031 - DNA, 21 bp, Artificial Sequence
  Description of Artificial Sequence: Synthetic oligonucleotide
  Description of Combined DNA/RNA Molecule: Synthetic oligonucleotide
uugaaggggagcgugugaatt

SEQ ID NO: 1032 - DNA, 21 bp, Artificial Sequence
  Description of Artificial Sequence: Synthetic oligonucleotide
  Description of Combined DNA/RNA Molecule: Synthetic oligonucleotide
cguggauacaggccucaaatt

SEQ ID NO: 1033 - DNA, 21 bp, Artificial Sequence
  Description of Artificial Sequence: Synthetic oligonucleotide
  Description of Combined DNA/RNA Molecule: Synthetic oligonucleotide
aacccucaaggagcugcuatt

SEQ ID NO: 1034 - DNA, 21 bp, Artificial Sequence
  Description of Artificial Sequence: Synthetic oligonucleotide
  Description of Combined DNA/RNA Molecule: Synthetic oligonucleotide
uggaccucaaggcucagcatt

SEQ ID NO: 1035 - DNA, 21 bp, Artificial Sequence
  Description of Artificial Sequence: Synthetic oligonucleotide
  Description of Combined DNA/RNA Molecule: Synthetic oligonucleotide
acccugacgccaagcuggutt

SEQ ID NO: 1036 - DNA, 21 bp, Artificial Sequence
  Description of Artificial Sequence: Synthetic oligonucleotide
  Description of Combined DNA/RNA Molecule: Synthetic oligonucleotide
ucguggggaacacggagautt

SEQ ID NO: 1037 - DNA, 21 bp, Artificial Sequence
  Description of Artificial Sequence: Synthetic oligonucleotide
  Description of Combined DNA/RNA Molecule: Synthetic oligonucleotide
auuggcauugagaugaagutt

SEQ ID NO: 1038 - DNA, 21 bp, Artificial Sequence
  Description of Artificial Sequence: Synthetic oligonucleotide
  Description of Combined DNA/RNA Molecule: Synthetic oligonucleotide
aaguucaagaauaugcugutt

SEQ ID NO: 1039 - DNA, 21 bp, Artificial Sequence
  Description of Artificial Sequence: Synthetic oligonucleotide
  Description of Combined DNA/RNA Molecule: Synthetic oligonucleotide
uuuccuaugauugucugcatt

SEQ ID NO: 1040 - DNA, 21 bp, Artificial Sequence
  Description of Artificial Sequence: Synthetic oligonucleotide
  Description of Combined DNA/RNA Molecule: Synthetic oligonucleotide
cccagccuggaucccugaatt

SEQ ID NO: 1041 - DNA, 21 bp, Artificial Sequence
  Description of Artificial Sequence: Synthetic oligonucleotide
  Description of Combined DNA/RNA Molecule: Synthetic oligonucleotide
agcugaauucgguagaacatt

SEQ ID NO: 1042 - DNA, 21 bp, Artificial Sequence
  Description of Artificial Sequence: Synthetic oligonucleotide
  Description of Combined DNA/RNA Molecule: Synthetic oligonucleotide
cauggacccgacgguaucutt

SEQ ID NO: 1043 - DNA, 21 bp, Artificial Sequence
  Description of Artificial Sequence: Synthetic oligonucleotide
  Description of Combined DNA/RNA Molecule: Synthetic oligonucleotide
ucuccuuuggagcugcuuatt

SEQ ID NO: 1044 - DNA, 21 bp, Artificial Sequence
  Description of Artificial Sequence: Synthetic oligonucleotide
  Description of Combined DNA/RNA Molecule: Synthetic oligonucleotide
ugcccccugagcauugugatt

SEQ ID NO: 1045 - DNA, 21 bp, Artificial Sequence
  Description of Artificial Sequence: Synthetic oligonucleotide
  Description of Combined DNA/RNA Molecule: Synthetic oligonucleotide
aaaaaacccugguggaugatt

SEQ ID NO: 1046 - DNA, 21 bp, Artificial Sequence
  Description of Artificial Sequence: Synthetic oligonucleotide
  Description of Combined DNA/RNA Molecule: Synthetic oligonucleotide
ugcuguugcuaagcuuccutt

SEQ ID NO: 1047 - DNA, 21 bp, Artificial Sequence
  Description of Artificial Sequence: Synthetic oligonucleotide
  Description of Combined DNA/RNA Molecule: Synthetic oligonucleotide
ccugcccaaaagacagagatt

SEQ ID NO: 1048 - DNA, 21 bp, Artificial Sequence
  Description of Artificial Sequence: Synthetic oligonucleotide
  Description of Combined DNA/RNA Molecule: Synthetic oligonucleotide
uguucagagggguccuggatt

SEQ ID NO: 1049 - DNA, 21 bp, Artificial Sequence
  Description of Artificial Sequence: Synthetic oligonucleotide
  Description of Combined DNA/RNA Molecule: Synthetic oligonucleotide
uggagcagcugcgcugguutt

SEQ ID NO: 1050 - DNA, 21 bp, Artificial Sequence
  Description of Artificial Sequence: Synthetic oligonucleotide
  Description of Combined DNA/RNA Molecule: Synthetic oligonucleotide
uuugcugggaagcaagucatt

SEQ ID NO: 1051 - DNA, 21 bp, Artificial Sequence
  Description of Artificial Sequence: Synthetic oligonucleotide
  Description of Combined DNA/RNA Molecule: Synthetic oligonucleotide
caagucuguggcguccguutt

SEQ ID NO: 1052 - DNA, 21 bp, Artificial Sequence
  Description of Artificial Sequence: Synthetic oligonucleotide
  Description of Combined DNA/RNA Molecule: Synthetic oligonucleotide
uggagggaacaucaucacutt

SEQ ID NO: 1053 - DNA, 21 bp, Artificial Sequence
  Description of Artificial Sequence: Synthetic oligonucleotide
  Description of Combined DNA/RNA Molecule: Synthetic oligonucleotide
ugccagccccaucuccgaatt

SEQ ID NO: 1054 - DNA, 21 bp, Artificial Sequence
  Description of Artificial Sequence: Synthetic oligonucleotide
  Description of Combined DNA/RNA Molecule: Synthetic oligonucleotide
accucaaccccguguucautt

SEQ ID NO: 1055 - DNA, 21 bp, Artificial Sequence
  Description of Artificial Sequence: Synthetic oligonucleotide
  Description of Combined DNA/RNA Molecule: Synthetic oligonucleotide
ucauggccaguggggccaatt

SEQ ID NO: 1056 - DNA, 21 bp, Artificial Sequence
  Description of Artificial Sequence: Synthetic oligonucleotide
  Description of Combined DNA/RNA Molecule: Synthetic oligonucleotide
aagcugacacuuguguccatt

SEQ ID NO: 1057 - DNA, 21 bp, Artificial Sequence
  Description of Artificial Sequence: Synthetic oligonucleotide
  Description of Combined DNA/RNA Molecule: Synthetic oligonucleotide
cagaggcaccaggagaacutt

SEQ ID NO: 1058 - DNA, 21 bp, Artificial Sequence
  Description of Artificial Sequence: Synthetic oligonucleotide
  Description of Combined DNA/RNA Molecule: Synthetic oligonucleotide
uguccagauggaccacacatt

SEQ ID NO: 1059 - DNA, 21 bp, Artificial Sequence
  Description of Artificial Sequence: Synthetic oligonucleotide
  Description of Combined DNA/RNA Molecule: Synthetic oligonucleotide
ccuucuucccuggcuacaatt

SEQ ID NO: 1060 - DNA, 21 bp, Artificial Sequence
  Description of Artificial Sequence: Synthetic oligonucleotide
  Description of Combined DNA/RNA Molecule: Synthetic oligonucleotide
agaaagacccugcugagcatt

SEQ ID NO: 1061 - DNA, 21 bp, Artificial Sequence
  Description of Artificial Sequence: Synthetic oligonucleotide
  Description of Combined DNA/RNA Molecule: Synthetic oligonucleotide
ccggaggagauacugcucutt

SEQ ID NO: 1062 - DNA, 21 bp, Artificial Sequence
  Description of Artificial Sequence: Synthetic oligonucleotide
  Description of Combined DNA/RNA Molecule: Synthetic oligonucleotide
cucuccauagagauccccutt

SEQ ID NO: 1063 - DNA, 21 bp, Artificial Sequence
  Description of Artificial Sequence: Synthetic oligonucleotide
  Description of Combined DNA/RNA Molecule: Synthetic oligonucleotide
uacagcagggagggggagutt

SEQ ID NO: 1064 - DNA, 21 bp, Artificial Sequence
  Description of Artificial Sequence: Synthetic oligonucleotide
  Description of Combined DNA/RNA Molecule: Synthetic oligonucleotide
aguauuucucagcauucaatt

SEQ ID NO: 1065 - DNA, 21 bp, Artificial Sequence
  Description of Artificial Sequence: Synthetic oligonucleotide
  Description of Combined DNA/RNA Molecule: Synthetic oligonucleotide
aagcaggccucccggagaatt

SEQ ID NO: 1066 - DNA, 21 bp, Artificial Sequence
  Description of Artificial Sequence: Synthetic oligonucleotide
  Description of Combined DNA/RNA Molecule: Synthetic oligonucleotide
aagaugacauugccaaggutt

SEQ ID NO: 1067 - DNA, 21 bp, Artificial Sequence
  Description of Artificial Sequence: Synthetic oligonucleotide
  Description of Combined DNA/RNA Molecule: Synthetic oligonucleotide
gguaaccaguggcaugagatt

SEQ ID NO: 1068 - DNA, 21 bp, Artificial Sequence
  Description of Artificial Sequence: Synthetic oligonucleotide
  Description of Combined DNA/RNA Molecule: Synthetic oligonucleotide
agaguuuuauucaagccaatt

SEQ ID NO: 1069 - DNA, 21 bp, Artificial Sequence
  Description of Artificial Sequence: Synthetic oligonucleotide
  Description of Combined DNA/RNA Molecule: Synthetic oligonucleotide
aggaaccacagagguacaatt

SEQ ID NO: 1070 - DNA, 21 bp, Artificial Sequence
  Description of Artificial Sequence: Synthetic oligonucleotide
  Description of Combined DNA/RNA Molecule: Synthetic oligonucleotide
aggagcuggcccuuugcuatt

SEQ ID NO: 1071 - DNA, 21 bp, Artificial Sequence
  Description of Artificial Sequence: Synthetic oligonucleotide
  Description of Combined DNA/RNA Molecule: Synthetic oligonucleotide
uaugguggaauggccaacatt

SEQ ID NO: 1072 - DNA, 21 bp, Artificial Sequence
  Description of Artificial Sequence: Synthetic oligonucleotide
  Description of Combined DNA/RNA Molecule: Synthetic oligonucleotide
agaaccaucucagcccucatt

SEQ ID NO: 1073 - DNA, 21 bp, Artificial Sequence
  Description of Artificial Sequence: Synthetic oligonucleotide
  Description of Combined DNA/RNA Molecule: Synthetic oligonucleotide
aagaccacucagaggcagatt

SEQ ID NO: 1074 - DNA, 21 bp, Artificial Sequence
  Description of Artificial Sequence: Synthetic oligonucleotide
  Description of Combined DNA/RNA Molecule: Synthetic oligonucleotide
cagcuuuccaagcucuggatt

SEQ ID NO: 1075 - DNA, 21 bp, Artificial Sequence
  Description of Artificial Sequence: Synthetic oligonucleotide
  Description of Combined DNA/RNA Molecule: Synthetic oligonucleotide
aggaggagcugcugcaggatt

SEQ ID NO: 1076 - DNA, 21 bp, Artificial Sequence
  Description of Artificial Sequence: Synthetic oligonucleotide
  Description of Combined DNA/RNA Molecule: Synthetic oligonucleotide
aggacgugugugcaggacutt

SEQ ID NO: 1077 - DNA, 21 bp, Artificial Sequence
  Description of Artificial Sequence: Synthetic oligonucleotide
  Description of Combined DNA/RNA Molecule: Synthetic oligonucleotide
uggcagaggagcugcaucutt

SEQ ID NO: 1078 - DNA, 21 bp, Artificial Sequence
  Description of Artificial Sequence: Synthetic oligonucleotide
  Description of Combined DNA/RNA Molecule: Synthetic oligonucleotide
ucugccucccgaugccccutt

SEQ ID NO: 1079 - DNA, 21 bp, Artificial Sequence
  Description of Artificial Sequence: Synthetic oligonucleotide
  Description of Combined DNA/RNA Molecule: Synthetic oligonucleotide
gguggcaugguggacuucatt

SEQ ID NO: 1080 - DNA, 21 bp, Artificial Sequence
  Description of Artificial Sequence: Synthetic oligonucleotide
  Description of Combined DNA/RNA Molecule: Synthetic oligonucleotide
uuccggugcacccucaccatt

SEQ ID NO: 1081 - DNA, 21 bp, Artificial Sequence
  Description of Artificial Sequence: Synthetic oligonucleotide
  Description of Combined DNA/RNA Molecule: Synthetic oligonucleotide
ucagcuucuucuucaaguutt

SEQ ID NO: 1082 - DNA, 21 bp, Artificial Sequence
  Description of Artificial Sequence: Synthetic oligonucleotide
  Description of Combined DNA/RNA Molecule: Synthetic oligonucleotide
uucuaccugacaguccuuatt

SEQ ID NO: 1083 - DNA, 21 bp, Artificial Sequence
  Description of Artificial Sequence: Synthetic oligonucleotide
  Description of Combined DNA/RNA Molecule: Synthetic oligonucleotide
gagaaccuggaagacaagutt

SEQ ID NO: 1084 - DNA, 21 bp, Artificial Sequence
  Description of Artificial Sequence: Synthetic oligonucleotide
  Description of Combined DNA/RNA Molecule: Synthetic oligonucleotide
ugugguaaacuggaccccatt

SEQ ID NO: 1085 - DNA, 21 bp, Artificial Sequence
  Description of Artificial Sequence: Synthetic oligonucleotide
  Description of Combined DNA/RNA Molecule: Synthetic oligonucleotide
cacuuucgccagugcaacutt

SEQ ID NO: 1086 - DNA, 21 bp, Artificial Sequence
  Description of Artificial Sequence: Synthetic oligonucleotide
  Description of Combined DNA/RNA Molecule: Synthetic oligonucleotide
acuuuacuguuucagaaagtt

SEQ ID NO: 1087 - DNA, 21 bp, Artificial Sequence
  Description of Artificial Sequence: Synthetic oligonucleotide
  Description of Combined DNA/RNA Molecule: Synthetic oligonucleotide
aagaccccccagccgaugutt

SEQ ID NO: 1088 - DNA, 21 bp, Artificial Sequence
  Description of Artificial Sequence: Synthetic oligonucleotide
  Description of Combined DNA/RNA Molecule: Synthetic oligonucleotide
uccagcucuuccaagaggutt

SEQ ID NO: 1089 - DNA, 21 bp, Artificial Sequence
  Description of Artificial Sequence: Synthetic oligonucleotide
  Description of Combined DNA/RNA Molecule: Synthetic oligonucleotide
ugcccaagggucagucugatt

SEQ ID NO: 1090 - DNA, 21 bp, Artificial Sequence
  Description of Artificial Sequence: Synthetic oligonucleotide
  Description of Combined DNA/RNA Molecule: Synthetic oligonucleotide
gaggaggacauggugggcatt

SEQ ID NO: 1091 - DNA, 21 bp, Artificial Sequence
  Description of Artificial Sequence: Synthetic oligonucleotide
  Description of Combined DNA/RNA Molecule: Synthetic oligonucleotide
gccggccccugccccaccutt

SEQ ID NO: 1092 - DNA, 21 bp, Artificial Sequence
  Description of Artificial Sequence: Synthetic oligonucleotide
  Description of Combined DNA/RNA Molecule: Synthetic oligonucleotide
ccuggcagcggacaugcaatt

SEQ ID NO: 1093 - DNA, 21 bp, Artificial Sequence
  Description of Artificial Sequence: Synthetic oligonucleotide
  Description of Combined DNA/RNA Molecule: Synthetic oligonucleotide
aggccucuggugaggccgutt

SEQ ID NO: 1094 - DNA, 21 bp, Artificial Sequence
  Description of Artificial Sequence: Synthetic oligonucleotide
  Description of Combined DNA/RNA Molecule: Synthetic oligonucleotide
uguacugugacgacauucatt

SEQ ID NO: 1095 - DNA, 21 bp, Artificial Sequence
  Description of Artificial Sequence: Synthetic oligonucleotide
  Description of Combined DNA/RNA Molecule: Synthetic oligonucleotide
cucgcuacgagaaugagcutt

SEQ ID NO: 1096 - DNA, 21 bp, Artificial Sequence
  Description of Artificial Sequence: Synthetic oligonucleotide
  Description of Combined DNA/RNA Molecule: Synthetic oligonucleotide
cugucucuccggcuggucatt

SEQ ID NO: 1097 - DNA, 21 bp, Artificial Sequence
  Description of Artificial Sequence: Synthetic oligonucleotide
  Description of Combined DNA/RNA Molecule: Synthetic oligonucleotide
ccacgccaagaucaagucatt

SEQ ID NO: 1098 - DNA, 21 bp, Artificial Sequence
  Description of Artificial Sequence: Synthetic oligonucleotide
  Description of Combined DNA/RNA Molecule: Synthetic oligonucleotide
cauagauacaucagaagcutt

SEQ ID NO: 1099 - DNA, 21 bp, Artificial Sequence
  Description of Artificial Sequence: Synthetic oligonucleotide
  Description of Combined DNA/RNA Molecule: Synthetic oligonucleotide
uuuguuuguuucauuuccatt

SEQ ID NO: 1100 - DNA, 21 bp, Artificial Sequence
  Description of Artificial Sequence: Synthetic oligonucleotide
  Description of Combined DNA/RNA Molecule: Synthetic oligonucleotide
gcugaugauguuccugggatt

SEQ ID NO: 1101 - DNA, 21 bp, Artificial Sequence
  Description of Artificial Sequence: Synthetic oligonucleotide
  Description of Combined DNA/RNA Molecule: Synthetic oligonucleotide
cagucuuugcgaaggauaatt

SEQ ID NO: 1102 - DNA, 21 bp, Artificial Sequence
  Description of Artificial Sequence: Synthetic oligonucleotide
  Description of Combined DNA/RNA Molecule: Synthetic oligonucleotide
aagguuacuuguguugggatt

SEQ ID NO: 1103 - DNA, 21 bp, Artificial Sequence
  Description of Artificial Sequence: Synthetic oligonucleotide
  Description of Combined DNA/RNA Molecule: Synthetic oligonucleotide
cauaucauuggugcugugatt

SEQ ID NO: 1104 - DNA, 21 bp, Artificial Sequence
  Description of Artificial Sequence: Synthetic oligonucleotide
  Description of Combined DNA/RNA Molecule: Synthetic oligonucleotide
ugguugcugacaccccggatt

SEQ ID NO: 1105 - DNA, 21 bp, Artificial Sequence
  Description of Artificial Sequence: Synthetic oligonucleotide
  Description of Combined DNA/RNA Molecule: Synthetic oligonucleotide
acacacacagagagcugcatt

SEQ ID NO: 1106 - DNA, 21 bp, Artificial Sequence
  Description of Artificial Sequence: Synthetic oligonucleotide
  Description of Combined DNA/RNA Molecule: Synthetic oligonucleotide
gcccaaggggugaaaaucatt

SEQ ID NO: 1107 - DNA, 21 bp, Artificial Sequence
  Description of Artificial Sequence: Synthetic oligonucleotide
  Description of Combined DNA/RNA Molecule: Synthetic oligonucleotide
ucaccuaugaagaacuacatt

SEQ ID NO: 1108 - DNA, 21 bp, Artificial Sequence
  Description of Artificial Sequence: Synthetic oligonucleotide
  Description of Combined DNA/RNA Molecule: Synthetic oligonucleotide
gaggaugcuauaaagaacatt

SEQ ID NO: 1109 - DNA, 21 bp, Artificial Sequence
  Description of Artificial Sequence: Synthetic oligonucleotide
  Description of Combined DNA/RNA Molecule: Synthetic oligonucleotide
caacuccuuuuauggaccutt

SEQ ID NO: 1110 - DNA, 21 bp, Artificial Sequence
  Description of Artificial Sequence: Synthetic oligonucleotide
  Description of Combined DNA/RNA Molecule: Synthetic oligonucleotide
ccugagcugaagaucgagatt

SEQ ID NO: 1111 - DNA, 21 bp, Artificial Sequence
  Description of Artificial Sequence: Synthetic oligonucleotide
  Description of Combined DNA/RNA Molecule: Synthetic oligonucleotide
aaaggggaccuaaagaagatt

SEQ ID NO: 1112 - DNA, 21 bp, Artificial Sequence
  Description of Artificial Sequence: Synthetic oligonucleotide
  Description of Combined DNA/RNA Molecule: Synthetic oligonucleotide
agggguuuuccgaagcagatt

SEQ ID NO: 1113 - DNA, 21 bp, Artificial Sequence
  Description of Artificial Sequence: Synthetic oligonucleotide
  Description of Combined DNA/RNA Molecule: Synthetic oligonucleotide
uaauguugugucaggggaatt

SEQ ID NO: 1114 - DNA, 21 bp, Artificial Sequence
  Description of Artificial Sequence: Synthetic oligonucleotide
  Description of Combined DNA/RNA Molecule: Synthetic oligonucleotide
agauauacaucgguggccatt

SEQ ID NO: 1115 - DNA, 21 bp, Artificial Sequence
  Description of Artificial Sequence: Synthetic oligonucleotide
  Description of Combined DNA/RNA Molecule: Synthetic oligonucleotide
gccaagagcacuucuaccutt

SEQ ID NO: 1116 - DNA, 21 bp, Artificial Sequence
  Description of Artificial Sequence: Synthetic oligonucleotide
  Description of Combined DNA/RNA Molecule: Synthetic oligonucleotide
ggagacucacugcaccauutt

SEQ ID NO: 1117 - DNA, 21 bp, Artificial Sequence
  Description of Artificial Sequence: Synthetic oligonucleotide
  Description of Combined DNA/RNA Molecule: Synthetic oligonucleotide
uugcuguuccaaaaggcgatt

SEQ ID NO: 1118 - DNA, 21 bp, Artificial Sequence
  Description of Artificial Sequence: Synthetic oligonucleotide
  Description of Combined DNA/RNA Molecule: Synthetic oligonucleotide
cgaggcaggggagauggaatt

SEQ ID NO: 1119 - DNA, 21 bp, Artificial Sequence
  Description of Artificial Sequence: Synthetic oligonucleotide
  Description of Combined DNA/RNA Molecule: Synthetic oligonucleotide
agcucuuugugucuacacatt

SEQ ID NO: 1120 - DNA, 21 bp, Artificial Sequence
  Description of Artificial Sequence: Synthetic oligonucleotide
  Description of Combined DNA/RNA Molecule: Synthetic oligonucleotide
cagaacaccaugaagaccatt

SEQ ID NO: 1121 - DNA, 21 bp, Artificial Sequence
  Description of Artificial Sequence: Synthetic oligonucleotide
  Description of Combined DNA/RNA Molecule: Synthetic oligonucleotide
cagagcuuuguugcaaaaatt

SEQ ID NO: 1122 - DNA, 21 bp, Artificial Sequence
  Description of Artificial Sequence: Synthetic oligonucleotide
  Description of Combined DNA/RNA Molecule: Synthetic oligonucleotide
aaaauguuggggguuccaatt

SEQ ID NO: 1123 - DNA, 21 bp, Artificial Sequence
  Description of Artificial Sequence: Synthetic oligonucleotide
  Description of Combined DNA/RNA Molecule: Synthetic oligonucleotide
agcaaaccggauugugguutt

SEQ ID NO: 1124 - DNA, 21 bp, Artificial Sequence
  Description of Artificial Sequence: Synthetic oligonucleotide
  Description of Combined DNA/RNA Molecule: Synthetic oligonucleotide
uucgagugaagagaauggatt

SEQ ID NO: 1125 - DNA, 21 bp, Artificial Sequence
  Description of Artificial Sequence: Synthetic oligonucleotide
  Description of Combined DNA/RNA Molecule: Synthetic oligonucleotide
aggaggcuuuggaggcaaatt

SEQ ID NO: 1126 - DNA, 21 bp, Artificial Sequence
  Description of Artificial Sequence: Synthetic oligonucleotide
  Description of Combined DNA/RNA Molecule: Synthetic oligonucleotide
aaggagacccggagcacuatt

SEQ ID NO: 1127 - DNA, 21 bp, Artificial Sequence
  Description of Artificial Sequence: Synthetic oligonucleotide
  Description of Combined DNA/RNA Molecule: Synthetic oligonucleotide
ugugguguccacggcaguatt

SEQ ID NO: 1128 - DNA, 21 bp, Artificial Sequence
  Description of Artificial Sequence: Synthetic oligonucleotide
  Description of Combined DNA/RNA Molecule: Synthetic oligonucleotide
uggcccuggcugcauauaatt

SEQ ID NO: 1129 - DNA, 21 bp, Artificial Sequence
  Description of Artificial Sequence: Synthetic oligonucleotide
  Description of Combined DNA/RNA Molecule: Synthetic oligonucleotide
ugcgaugcaugcuggaccatt

SEQ ID NO: 1130 - DNA, 21 bp, Artificial Sequence
  Description of Artificial Sequence: Synthetic oligonucleotide
  Description of Combined DNA/RNA Molecule: Synthetic oligonucleotide
cgugaugaggacaugcugatt

SEQ ID NO: 1131 - DNA, 21 bp, Artificial Sequence
  Description of Artificial Sequence: Synthetic oligonucleotide
  Description of Combined DNA/RNA Molecule: Synthetic oligonucleotide
uaacugguggcagacaucatt

SEQ ID NO: 1132 - DNA, 21 bp, Artificial Sequence
  Description of Artificial Sequence: Synthetic oligonucleotide
  Description of Combined DNA/RNA Molecule: Synthetic oligonucleotide
ucccuuccuggccagauaatt

SEQ ID NO: 1133 - DNA, 21 bp, Artificial Sequence
  Description of Artificial Sequence: Synthetic oligonucleotide
  Description of Combined DNA/RNA Molecule: Synthetic oligonucleotide
uacaagguuggcuucaugatt

SEQ ID NO: 1134 - DNA, 21 bp, Artificial Sequence
  Description of Artificial Sequence: Synthetic oligonucleotide
  Description of Combined DNA/RNA Molecule: Synthetic oligonucleotide
agacugggacaguuguggatt

SEQ ID NO: 1135 - DNA, 21 bp, Artificial Sequence
  Description of Artificial Sequence: Synthetic oligonucleotide
  Description of Combined DNA/RNA Molecule: Synthetic oligonucleotide
gcucuugagguggaccacutt

SEQ ID NO: 1136 - DNA, 21 bp, Artificial Sequence
  Description of Artificial Sequence: Synthetic oligonucleotide
  Description of Combined DNA/RNA Molecule: Synthetic oligonucleotide
acuucagcaauguggggaatt

SEQ ID NO: 1137 - DNA, 21 bp, Artificial Sequence
  Description of Artificial Sequence: Synthetic oligonucleotide
  Description of Combined DNA/RNA Molecule: Synthetic oligonucleotide
gaacacccaggaucucucutt

SEQ ID NO: 1138 - DNA, 21 bp, Artificial Sequence
  Description of Artificial Sequence: Synthetic oligonucleotide
  Description of Combined DNA/RNA Molecule: Synthetic oligonucleotide
cagaguauuauggaacgaatt

SEQ ID NO: 1139 - DNA, 21 bp, Artificial Sequence
  Description of Artificial Sequence: Synthetic oligonucleotide
  Description of Combined DNA/RNA Molecule: Synthetic oligonucleotide
agcuuuauuccacauggaatt

SEQ ID NO: 1140 - DNA, 21 bp, Artificial Sequence
  Description of Artificial Sequence: Synthetic oligonucleotide
  Description of Combined DNA/RNA Molecule: Synthetic oligonucleotide
acaacugcuauaaaauccatt

SEQ ID NO: 1141 - DNA, 21 bp, Artificial Sequence
  Description of Artificial Sequence: Synthetic oligonucleotide
  Description of Combined DNA/RNA Molecule: Synthetic oligonucleotide
uccccaacauccggggcaatt

SEQ ID NO: 1142 - DNA, 21 bp, Artificial Sequence
  Description of Artificial Sequence: Synthetic oligonucleotide
  Description of Combined DNA/RNA Molecule: Synthetic oligonucleotide
ugggcggcugugcaaaacatt

SEQ ID NO: 1143 - DNA, 21 bp, Artificial Sequence
  Description of Artificial Sequence: Synthetic oligonucleotide
  Description of Combined DNA/RNA Molecule: Synthetic oligonucleotide
aaccaaccuucccuccaaatt

SEQ ID NO: 1144 - DNA, 21 bp, Artificial Sequence
  Description of Artificial Sequence: Synthetic oligonucleotide
  Description of Combined DNA/RNA Molecule: Synthetic oligonucleotide
acacggccuuccggggcuutt

SEQ ID NO: 1145 - DNA, 21 bp, Artificial Sequence
  Description of Artificial Sequence: Synthetic oligonucleotide
  Description of Combined DNA/RNA Molecule: Synthetic oligonucleotide
uuggggggccccaggggautt

SEQ ID NO: 1146 - DNA, 21 bp, Artificial Sequence
  Description of Artificial Sequence: Synthetic oligonucleotide
  Description of Combined DNA/RNA Molecule: Synthetic oligonucleotide
augcucauugccgagugcutt

SEQ ID NO: 1147 - DNA, 21 bp, Artificial Sequence
  Description of Artificial Sequence: Synthetic oligonucleotide
  Description of Combined DNA/RNA Molecule: Synthetic oligonucleotide
uggaugagugaaguugcaatt

SEQ ID NO: 1148 - DNA, 21 bp, Artificial Sequence
  Description of Artificial Sequence: Synthetic oligonucleotide
  Description of Combined DNA/RNA Molecule: Synthetic oligonucleotide
agugaccugugggaugccutt

SEQ ID NO: 1149 - DNA, 21 bp, Artificial Sequence
  Description of Artificial Sequence: Synthetic oligonucleotide
  Description of Combined DNA/RNA Molecule: Synthetic oligonucleotide
ccugcagaggaggugcggatt

SEQ ID NO: 1150 - DNA, 21 bp, Artificial Sequence
  Description of Artificial Sequence: Synthetic oligonucleotide
  Description of Combined DNA/RNA Molecule: Synthetic oligonucleotide
agaaaaaaccuguacaaagtt

SEQ ID NO: 1151 - DNA, 21 bp, Artificial Sequence
  Description of Artificial Sequence: Synthetic oligonucleotide
  Description of Combined DNA/RNA Molecule: Synthetic oligonucleotide
aaagaaggggaccugacaatt

SEQ ID NO: 1152 - DNA, 21 bp, Artificial Sequence
  Description of Artificial Sequence: Synthetic oligonucleotide
  Description of Combined DNA/RNA Molecule: Synthetic oligonucleotide
acacuucaaccagaagcuutt

SEQ ID NO: 1153 - DNA, 21 bp, Artificial Sequence
  Description of Artificial Sequence: Synthetic oligonucleotide
  Description of Combined DNA/RNA Molecule: Synthetic oligonucleotide
uugaggguuucaccuugcatt

SEQ ID NO: 1154 - DNA, 21 bp, Artificial Sequence
  Description of Artificial Sequence: Synthetic oligonucleotide
  Description of Combined DNA/RNA Molecule: Synthetic oligonucleotide
cagaugcugggaagaaugatt

SEQ ID NO: 1155 - DNA, 21 bp, Artificial Sequence
  Description of Artificial Sequence: Synthetic oligonucleotide
  Description of Combined DNA/RNA Molecule: Synthetic oligonucleotide
ugccuagcaagcucucagutt

SEQ ID NO: 1156 - DNA, 21 bp, Artificial Sequence
  Description of Artificial Sequence: Synthetic oligonucleotide
  Description of Combined DNA/RNA Molecule: Synthetic oligonucleotide
uaucaugcucggaagaguatt

SEQ ID NO: 1157 - DNA, 21 bp, Artificial Sequence
  Description of Artificial Sequence: Synthetic oligonucleotide
  Description of Combined DNA/RNA Molecule: Synthetic oligonucleotide
agugagguugacaaguucatt

SEQ ID NO: 1158 - DNA, 21 bp, Artificial Sequence
  Description of Artificial Sequence: Synthetic oligonucleotide
  Description of Combined DNA/RNA Molecule: Synthetic oligonucleotide
aacaaggagaauuguuggatt

SEQ ID NO: 1159 - DNA, 21 bp, Artificial Sequence
  Description of Artificial Sequence: Synthetic oligonucleotide
  Description of Combined DNA/RNA Molecule: Synthetic oligonucleotide
aaaaagagaggauugugcatt

SEQ ID NO: 1160 - DNA, 21 bp, Artificial Sequence
  Description of Artificial Sequence: Synthetic oligonucleotide
  Description of Combined DNA/RNA Molecule: Synthetic oligonucleotide
cauaauucccaccaaguuutt

SEQ ID NO: 1161 - DNA, 21 bp, Artificial Sequence
  Description of Artificial Sequence: Synthetic oligonucleotide
  Description of Combined DNA/RNA Molecule: Synthetic oligonucleotide
uuuggaauaagcuuuacaatt

SEQ ID NO: 1162 - DNA, 21 bp, Artificial Sequence
  Description of Artificial Sequence: Synthetic oligonucleotide
  Description of Combined DNA/RNA Molecule: Synthetic oligonucleotide
aguuccuuuucugaaucaatt

SEQ ID NO: 1163 - DNA, 21 bp, Artificial Sequence
  Description of Artificial Sequence: Synthetic oligonucleotide
  Description of Combined DNA/RNA Molecule: Synthetic oligonucleotide
aggcaggagcccuacuucatt

SEQ ID NO: 1164 - DNA, 21 bp, Artificial Sequence
  Description of Artificial Sequence: Synthetic oligonucleotide
  Description of Combined DNA/RNA Molecule: Synthetic oligonucleotide
cauguguacacagauggcutt

SEQ ID NO: 1165 - DNA, 21 bp, Artificial Sequence
  Description of Artificial Sequence: Synthetic oligonucleotide
  Description of Combined DNA/RNA Molecule: Synthetic oligonucleotide
ucugugcugcugacccacatt

SEQ ID NO: 1166 - DNA, 21 bp, Artificial Sequence
  Description of Artificial Sequence: Synthetic oligonucleotide
  Description of Combined DNA/RNA Molecule: Synthetic oligonucleotide
ggccaaggccuucauaccatt

SEQ ID NO: 1167 - DNA, 21 bp, Artificial Sequence
  Description of Artificial Sequence: Synthetic oligonucleotide
  Description of Combined DNA/RNA Molecule: Synthetic oligonucleotide
aaaaugguccagguggccatt

SEQ ID NO: 1168 - DNA, 21 bp, Artificial Sequence
  Description of Artificial Sequence: Synthetic oligonucleotide
  Description of Combined DNA/RNA Molecule: Synthetic oligonucleotide
gccaguagagcucugaaaatt

SEQ ID NO: 1169 - DNA, 21 bp, Artificial Sequence
  Description of Artificial Sequence: Synthetic oligonucleotide
  Description of Combined DNA/RNA Molecule: Synthetic oligonucleotide
aauccccaccucuaagauutt

SEQ ID NO: 1170 - DNA, 21 bp, Artificial Sequence
  Description of Artificial Sequence: Synthetic oligonucleotide
  Description of Combined DNA/RNA Molecule: Synthetic oligonucleotide
uauaucagcgagacaagcatt

SEQ ID NO: 1171 - DNA, 21 bp, Artificial Sequence
  Description of Artificial Sequence: Synthetic oligonucleotide
  Description of Combined DNA/RNA Molecule: Synthetic oligonucleotide
agcacuaacacugugcccatt

SEQ ID NO: 1172 - DNA, 21 bp, Artificial Sequence
  Description of Artificial Sequence: Synthetic oligonucleotide
  Description of Combined DNA/RNA Molecule: Synthetic oligonucleotide
caacaccucucccacggcutt

SEQ ID NO: 1173 - DNA, 21 bp, Artificial Sequence
  Description of Artificial Sequence: Synthetic oligonucleotide
  Description of Combined DNA/RNA Molecule: Synthetic oligonucleotide
ugccucugucagcgcugaatt

SEQ ID NO: 1174 - DNA, 21 bp, Artificial Sequence
  Description of Artificial Sequence: Synthetic oligonucleotide
  Description of Combined DNA/RNA Molecule: Synthetic oligonucleotide
accucaauggacaggccgutt

SEQ ID NO: 1175 - DNA, 21 bp, Artificial Sequence
  Description of Artificial Sequence: Synthetic oligonucleotide
  Description of Combined DNA/RNA Molecule: Synthetic oligonucleotide
gucuaugcggcuugucagatt

SEQ ID NO: 1176 - DNA, 21 bp, Artificial Sequence
  Description of Artificial Sequence: Synthetic oligonucleotide
  Description of Combined DNA/RNA Molecule: Synthetic oligonucleotide
agaccaucuugaaaaggcutt

SEQ ID NO: 1177 - DNA, 21 bp, Artificial Sequence
  Description of Artificial Sequence: Synthetic oligonucleotide
  Description of Combined DNA/RNA Molecule: Synthetic oligonucleotide
uggaacccuacaagaagaatt

SEQ ID NO: 1178 - DNA, 21 bp, Artificial Sequence
  Description of Artificial Sequence: Synthetic oligonucleotide
  Description of Combined DNA/RNA Molecule: Synthetic oligonucleotide
aagaaucccaguggcuccutt

SEQ ID NO: 1179 - DNA, 21 bp, Artificial Sequence
  Description of Artificial Sequence: Synthetic oligonucleotide
  Description of Combined DNA/RNA Molecule: Synthetic oligonucleotide
ugggaagacugggucacaatt

SEQ ID NO: 1180 - DNA, 21 bp, Artificial Sequence
  Description of Artificial Sequence: Synthetic oligonucleotide
  Description of Combined DNA/RNA Molecule: Synthetic oligonucleotide
acagcugccuacauggacatt

SEQ ID NO: 1181 - DNA, 21 bp, Artificial Sequence
  Description of Artificial Sequence: Synthetic oligonucleotide
  Description of Combined DNA/RNA Molecule: Synthetic oligonucleotide
acagugagcuugucugccatt

SEQ ID NO: 1182 - DNA, 21 bp, Artificial Sequence
  Description of Artificial Sequence: Synthetic oligonucleotide
  Description of Combined DNA/RNA Molecule: Synthetic oligonucleotide
acuggguuuuauagaacaatt

SEQ ID NO: 1183 - DNA, 21 bp, Artificial Sequence
  Description of Artificial Sequence: Synthetic oligonucleotide
  Description of Combined DNA/RNA Molecule: Synthetic oligonucleotide
acccaaucugggcuacagatt

SEQ ID NO: 1184 - DNA, 21 bp, Artificial Sequence
  Description of Artificial Sequence: Synthetic oligonucleotide
  Description of Combined DNA/RNA Molecule: Synthetic oligonucleotide
cagcuuugagacuaacucatt

SEQ ID NO: 1185 - DNA, 21 bp, Artificial Sequence
  Description of Artificial Sequence: Synthetic oligonucleotide
  Description of Combined DNA/RNA Molecule: Synthetic oligonucleotide
gggaaccccuuccacuacutt

SEQ ID NO: 1186 - DNA, 21 bp, Artificial Sequence
  Description of Artificial Sequence: Synthetic oligonucleotide
  Description of Combined DNA/RNA Molecule: Synthetic oligonucleotide
cuucagcuaugggguggcutt

SEQ ID NO: 1187 - DNA, 21 bp, Artificial Sequence
  Description of Artificial Sequence: Synthetic oligonucleotide
  Description of Combined DNA/RNA Molecule: Synthetic oligonucleotide
cuugcucugaaguagaaautt

SEQ ID NO: 1188 - DNA, 21 bp, Artificial Sequence
  Description of Artificial Sequence: Synthetic oligonucleotide
  Description of Combined DNA/RNA Molecule: Synthetic oligonucleotide
aaaucgacugccuaacagatt

SEQ ID NO: 1189 - DNA, 21 bp, Artificial Sequence
  Description of Artificial Sequence: Synthetic oligonucleotide
  Description of Combined DNA/RNA Molecule: Synthetic oligonucleotide
gagaucauaagaaccuccatt

SEQ ID NO: 1190 - DNA, 21 bp, Artificial Sequence
  Description of Artificial Sequence: Synthetic oligonucleotide
  Description of Combined DNA/RNA Molecule: Synthetic oligonucleotide
gcacagauauugucauggatt

SEQ ID NO: 1191 - DNA, 21 bp, Artificial Sequence
  Description of Artificial Sequence: Synthetic oligonucleotide
  Description of Combined DNA/RNA Molecule: Synthetic oligonucleotide
uggauguuggcuccagucutt

SEQ ID NO: 1192 - DNA, 21 bp, Artificial Sequence
  Description of Artificial Sequence: Synthetic oligonucleotide
  Description of Combined DNA/RNA Molecule: Synthetic oligonucleotide
uaaacccugccauugauautt

SEQ ID NO: 1193 - DNA, 21 bp, Artificial Sequence
  Description of Artificial Sequence: Synthetic oligonucleotide
  Description of Combined DNA/RNA Molecule: Synthetic oligonucleotide
uuggacagguggaaggggatt

SEQ ID NO: 1194 - DNA, 21 bp, Artificial Sequence
  Description of Artificial Sequence: Synthetic oligonucleotide
  Description of Combined DNA/RNA Molecule: Synthetic oligonucleotide
gggcauuuguccagggccutt

SEQ ID NO: 1195 - DNA, 21 bp, Artificial Sequence
  Description of Artificial Sequence: Synthetic oligonucleotide
  Description of Combined DNA/RNA Molecule: Synthetic oligonucleotide
uuggccucuucacccuagatt

SEQ ID NO: 1196 - DNA, 21 bp, Artificial Sequence
  Description of Artificial Sequence: Synthetic oligonucleotide
  Description of Combined DNA/RNA Molecule: Synthetic oligonucleotide
agaggagcuacacuauucatt

SEQ ID NO: 1197 - DNA, 21 bp, Artificial Sequence
  Description of Artificial Sequence: Synthetic oligonucleotide
  Description of Combined DNA/RNA Molecule: Synthetic oligonucleotide
ccccgaggggagccugcaatt

SEQ ID NO: 1198 - DNA, 21 bp, Artificial Sequence
  Description of Artificial Sequence: Synthetic oligonucleotide
  Description of Combined DNA/RNA Molecule: Synthetic oligonucleotide
cacacccguggcccuagcatt

SEQ ID NO: 1199 - DNA, 21 bp, Artificial Sequence
  Description of Artificial Sequence: Synthetic oligonucleotide
  Description of Combined DNA/RNA Molecule: Synthetic oligonucleotide
accuacaagaucccggcautt

SEQ ID NO: 1200 - DNA, 21 bp, Artificial Sequence
  Description of Artificial Sequence: Synthetic oligonucleotide
  Description of Combined DNA/RNA Molecule: Synthetic oligonucleotide
uuuggcagcauccccauuatt

SEQ ID NO: 1201 - DNA, 21 bp, Artificial Sequence
  Description of Artificial Sequence: Synthetic oligonucleotide
  Description of Combined DNA/RNA Molecule: Synthetic oligonucleotide
ccugcuccgcgacugcccatt

SEQ ID NO: 1202 - DNA, 21 bp, Artificial Sequence
  Description of Artificial Sequence: Synthetic oligonucleotide
  Description of Combined DNA/RNA Molecule: Synthetic oligonucleotide
caacaagaaggccaucuautt

SEQ ID NO: 1203 - DNA, 21 bp, Artificial Sequence
  Description of Artificial Sequence: Synthetic oligonucleotide
  Description of Combined DNA/RNA Molecule: Synthetic oligonucleotide
uaugcaucgaaggcuguuatt

SEQ ID NO: 1204 - DNA, 21 bp, Artificial Sequence
  Description of Artificial Sequence: Synthetic oligonucleotide
  Description of Combined DNA/RNA Molecule: Synthetic oligonucleotide
uggagagccgccccucuuatt

SEQ ID NO: 1205 - DNA, 21 bp, Artificial Sequence
  Description of Artificial Sequence: Synthetic oligonucleotide
  Description of Combined DNA/RNA Molecule: Synthetic oligonucleotide
uccuggcugcuucuaucuutt

SEQ ID NO: 1206 - DNA, 21 bp, Artificial Sequence
  Description of Artificial Sequence: Synthetic oligonucleotide
  Description of Combined DNA/RNA Molecule: Synthetic oligonucleotide
uucuuugccaucaaagauatt

SEQ ID NO: 1207 - DNA, 21 bp, Artificial Sequence
  Description of Artificial Sequence: Synthetic oligonucleotide
  Description of Combined DNA/RNA Molecule: Synthetic oligonucleotide
ccauccgugcagcucgagatt

SEQ ID NO: 1208 - DNA, 21 bp, Artificial Sequence
  Description of Artificial Sequence: Synthetic oligonucleotide
  Description of Combined DNA/RNA Molecule: Synthetic oligonucleotide
agcucagcacacagguaautt

SEQ ID NO: 1209 - DNA, 21 bp, Artificial Sequence
  Description of Artificial Sequence: Synthetic oligonucleotide
  Description of Combined DNA/RNA Molecule: Synthetic oligonucleotide
aauaacgugaaggaacucutt

SEQ ID NO: 1210 - DNA, 21 bp, Artificial Sequence
  Description of Artificial Sequence: Synthetic oligonucleotide
  Description of Combined DNA/RNA Molecule: Synthetic oligonucleotide
uuccggcuagacagcccuatt

SEQ ID NO: 1211 - DNA, 21 bp, Artificial Sequence
  Description of Artificial Sequence: Synthetic oligonucleotide
  Description of Combined DNA/RNA Molecule: Synthetic oligonucleotide
ugccaccccggagaagauatt

SEQ ID NO: 1212 - DNA, 21 bp, Artificial Sequence
  Description of Artificial Sequence: Synthetic oligonucleotide
  Description of Combined DNA/RNA Molecule: Synthetic oligonucleotide
auccgcaaugccugcgugatt

SEQ ID NO: 1213 - DNA, 21 bp, Artificial Sequence
  Description of Artificial Sequence: Synthetic oligonucleotide
  Description of Combined DNA/RNA Molecule: Synthetic oligonucleotide
gacaaguucaccacccugutt

SEQ ID NO: 1214 - DNA, 21 bp, Artificial Sequence
  Description of Artificial Sequence: Synthetic oligonucleotide
  Description of Combined DNA/RNA Molecule: Synthetic oligonucleotide
ugugugucacugguguccatt

SEQ ID NO: 1215 - DNA, 21 bp, Artificial Sequence
  Description of Artificial Sequence: Synthetic oligonucleotide
  Description of Combined DNA/RNA Molecule: Synthetic oligonucleotide
agaaaacugcaaacccugatt

SEQ ID NO: 1216 - DNA, 21 bp, Artificial Sequence
  Description of Artificial Sequence: Synthetic oligonucleotide
  Description of Combined DNA/RNA Molecule: Synthetic oligonucleotide
cuggucugugagggucuaatt

SEQ ID NO: 1217 - DNA, 21 bp, Artificial Sequence
  Description of Artificial Sequence: Synthetic oligonucleotide
  Description of Combined DNA/RNA Molecule: Synthetic oligonucleotide
aaagagagaguccucagcatt

SEQ ID NO: 1218 - DNA, 21 bp, Artificial Sequence
  Description of Artificial Sequence: Synthetic oligonucleotide
  Description of Combined DNA/RNA Molecule: Synthetic oligonucleotide
agagucuucuugugcugcatt

SEQ ID NO: 1219 - DNA, 21 bp, Artificial Sequence
  Description of Artificial Sequence: Synthetic oligonucleotide
  Description of Combined DNA/RNA Molecule: Synthetic oligonucleotide
gccuuugggcuuccauggatt

SEQ ID NO: 1220 - DNA, 21 bp, Artificial Sequence
  Description of Artificial Sequence: Synthetic oligonucleotide
  Description of Combined DNA/RNA Molecule: Synthetic oligonucleotide
cagaacauggaucuauuaatt

SEQ ID NO: 1221 - DNA, 21 bp, Artificial Sequence
  Description of Artificial Sequence: Synthetic oligonucleotide
  Description of Combined DNA/RNA Molecule: Synthetic oligonucleotide
uuaaagucacagaaugacatt

SEQ ID NO: 1222 - DNA, 21 bp, Artificial Sequence
  Description of Artificial Sequence: Synthetic oligonucleotide
  Description of Combined DNA/RNA Molecule: Synthetic oligonucleotide
agaccugugauuugucaaatt

SEQ ID NO: 1223 - DNA, 21 bp, Artificial Sequence
  Description of Artificial Sequence: Synthetic oligonucleotide
  Description of Combined DNA/RNA Molecule: Synthetic oligonucleotide
agaugggauuuggaagacatt

SEQ ID NO: 1224 - DNA, 21 bp, Artificial Sequence
  Description of Artificial Sequence: Synthetic oligonucleotide
  Description of Combined DNA/RNA Molecule: Synthetic oligonucleotide
aagugaaugcaauggaagatt

SEQ ID NO: 1225 - DNA, 21 bp, Artificial Sequence
  Description of Artificial Sequence: Synthetic oligonucleotide
  Description of Combined DNA/RNA Molecule: Synthetic oligonucleotide
aagauuuugaucaaaaauatt

SEQ ID NO: 1226 - DNA, 21 bp, Artificial Sequence
  Description of Artificial Sequence: Synthetic oligonucleotide
  Description of Combined DNA/RNA Molecule: Synthetic oligonucleotide
uguaauuuguaaacacaautt

SEQ ID NO: 1227 - DNA, 21 bp, Artificial Sequence
  Description of Artificial Sequence: Synthetic oligonucleotide
  Description of Combined DNA/RNA Molecule: Synthetic oligonucleotide
gauaagcaaauucaaaacutt

SEQ ID NO: 1228 - DNA, 21 bp, Artificial Sequence
  Description of Artificial Sequence: Synthetic oligonucleotide
  Description of Combined DNA/RNA Molecule: Synthetic oligonucleotide
acuguuaugccuaaauggutt

SEQ ID NO: 1229 - DNA, 21 bp, Artificial Sequence
  Description of Artificial Sequence: Synthetic oligonucleotide
  Description of Combined DNA/RNA Molecule: Synthetic oligonucleotide
ugaauaugcaauuaggauatt

SEQ ID NO: 1230 - DNA, 21 bp, Artificial Sequence
  Description of Artificial Sequence: Synthetic oligonucleotide
  Description of Combined DNA/RNA Molecule: Synthetic oligonucleotide
aucauuuucugucuguuuutt

SEQ ID NO: 1231 - DNA, 21 bp, Artificial Sequence
  Description of Artificial Sequence: Synthetic oligonucleotide
  Description of Combined DNA/RNA Molecule: Synthetic oligonucleotide
uuaaucauguaucuggaautt

SEQ ID NO: 1232 - DNA, 21 bp, Artificial Sequence
  Description of Artificial Sequence: Synthetic oligonucleotide
  Description of Combined DNA/RNA Molecule: Synthetic oligonucleotide
aauagggucgggaaggguutt

SEQ ID NO: 1233 - DNA, 21 bp, Artificial Sequence
  Description of Artificial Sequence: Synthetic oligonucleotide
  Description of Combined DNA/RNA Molecule: Synthetic oligonucleotide
uuugugcuauuccccacuutt

SEQ ID NO: 1234 - DNA, 21 bp, Artificial Sequence
  Description of Artificial Sequence: Synthetic oligonucleotide
  Description of Combined DNA/RNA Molecule: Synthetic oligonucleotide
uuacuggacagccuguauatt

SEQ ID NO: 1235 - DNA, 21 bp, Artificial Sequence
  Description of Artificial Sequence: Synthetic oligonucleotide
  Description of Combined DNA/RNA Molecule: Synthetic oligonucleotide
aaccucaaguucugauggutt

SEQ ID NO: 1236 - DNA, 21 bp, Artificial Sequence
  Description of Artificial Sequence: Synthetic oligonucleotide
  Description of Combined DNA/RNA Molecule: Synthetic oligonucleotide
ugucuguccuuugaagagatt

SEQ ID NO: 1237 - DNA, 21 bp, Artificial Sequence
  Description of Artificial Sequence: Synthetic oligonucleotide
  Description of Combined DNA/RNA Molecule: Synthetic oligonucleotide
aggauucccacaaaccucutt

SEQ ID NO: 1238 - DNA, 21 bp, Artificial Sequence
  Description of Artificial Sequence: Synthetic oligonucleotide
  Description of Combined DNA/RNA Molecule: Synthetic oligonucleotide
uagaagcuuaaaccgaagutt

SEQ ID NO: 1239 - DNA, 21 bp, Artificial Sequence
  Description of Artificial Sequence: Synthetic oligonucleotide
  Description of Combined DNA/RNA Molecule: Synthetic oligonucleotide
aaguuacuuuaaaucgugutt

SEQ ID NO: 1240 - DNA, 21 bp, Artificial Sequence
  Description of Artificial Sequence: Synthetic oligonucleotide
  Description of Combined DNA/RNA Molecule: Synthetic oligonucleotide
ugccuuccugugaaagccutt

SEQ ID NO: 1241 - DNA, 21 bp, Artificial Sequence
  Description of Artificial Sequence: Synthetic oligonucleotide
  Description of Combined DNA/RNA Molecule: Synthetic oligonucleotide
cuggccuucaaaccaaugatt

SEQ ID NO: 1242 - DNA, 21 bp, Artificial Sequence
  Description of Artificial Sequence: Synthetic oligonucleotide
  Description of Combined DNA/RNA Molecule: Synthetic oligonucleotide
aacagcaaagcauaaccuutt

SEQ ID NO: 1243 - DNA, 21 bp, Artificial Sequence
  Description of Artificial Sequence: Synthetic oligonucleotide
  Description of Combined DNA/RNA Molecule: Synthetic oligonucleotide
uugaaucuauacucaaauutt

SEQ ID NO: 1244 - DNA, 21 bp, Artificial Sequence
  Description of Artificial Sequence: Synthetic oligonucleotide
  Description of Combined DNA/RNA Molecule: Synthetic oligonucleotide
uuuugcaaugaggcagugatt

SEQ ID NO: 1245 - DNA, 21 bp, Artificial Sequence
  Description of Artificial Sequence: Synthetic oligonucleotide
  Description of Combined DNA/RNA Molecule: Synthetic oligonucleotide
ugggguaagguuaaauccutt

SEQ ID NO: 1246 - DNA, 21 bp, Artificial Sequence
  Description of Artificial Sequence: Synthetic oligonucleotide
  Description of Combined DNA/RNA Molecule: Synthetic oligonucleotide
ucuaaccaucuuugaaucatt

SEQ ID NO: 1247 - DNA, 21 bp, Artificial Sequence
  Description of Artificial Sequence: Synthetic oligonucleotide
  Description of Combined DNA/RNA Molecule: Synthetic oligonucleotide
aucauuggaaagaauaaagtt

SEQ ID NO: 1248 - DNA, 21 bp, Artificial Sequence
  Description of Artificial Sequence: Synthetic oligonucleotide
  Description of Combined DNA/RNA Molecule: Synthetic oligonucleotide
aaugaaacaaauucaaggutt

SEQ ID NO: 1249 - DNA, 21 bp, Artificial Sequence
  Description of Artificial Sequence: Synthetic oligonucleotide
  Description of Combined DNA/RNA Molecule: Synthetic oligonucleotide
agguuaauuggaucugauutt

SEQ ID NO: 1250 - DNA, 21 bp, Artificial Sequence
  Description of Artificial Sequence: Synthetic oligonucleotide
  Description of Combined DNA/RNA Molecule: Synthetic oligonucleotide
uuugugaagcugcauaaagtt

SEQ ID NO: 1251 - DNA, 21 bp, Artificial Sequence
  Description of Artificial Sequence: Synthetic oligonucleotide
  Description of Combined DNA/RNA Molecule: Synthetic oligonucleotide
agcaagauuacucuauaautt

SEQ ID NO: 1252 - DNA, 21 bp, Artificial Sequence
  Description of Artificial Sequence: Synthetic oligonucleotide
  Description of Combined DNA/RNA Molecule: Synthetic oligonucleotide
uacaaaaauccaaccaacutt

SEQ ID NO: 1253 - DNA, 21 bp, Artificial Sequence
  Description of Artificial Sequence: Synthetic oligonucleotide
  Description of Combined DNA/RNA Molecule: Synthetic oligonucleotide
acucaauuauugagcacgutt

SEQ ID NO: 1254 - DNA, 21 bp, Artificial Sequence
  Description of Artificial Sequence: Synthetic oligonucleotide
  Description of Combined DNA/RNA Molecule: Synthetic oligonucleotide
uacaauguucuagauuucutt

SEQ ID NO: 1255 - DNA, 21 bp, Artificial Sequence
  Description of Artificial Sequence: Synthetic oligonucleotide
  Description of Combined DNA/RNA Molecule: Synthetic oligonucleotide
uucuuucccuuccucuuuatt

SEQ ID NO: 1256 - DNA, 21 bp, Artificial Sequence
  Description of Artificial Sequence: Synthetic oligonucleotide
  Description of Combined DNA/RNA Molecule: Synthetic oligonucleotide
gaagagaauauuuguauuatt

SEQ ID NO: 1257 - DNA, 21 bp, Artificial Sequence
  Description of Artificial Sequence: Synthetic oligonucleotide
  Description of Combined DNA/RNA Molecule: Synthetic oligonucleotide
uuccaaauacucuuugagutt

SEQ ID NO: 1258 - DNA, 21 bp, Artificial Sequence
  Description of Artificial Sequence: Synthetic oligonucleotide
  Description of Combined DNA/RNA Molecule: Synthetic oligonucleotide
uauuuacaaaaaagauuautt

SEQ ID NO: 1259 - DNA, 21 bp, Artificial Sequence
  Description of Artificial Sequence: Synthetic oligonucleotide
  Description of Combined DNA/RNA Molecule: Synthetic oligonucleotide
uauguuuaaucuuuacauutt

SEQ ID NO: 1260 - DNA, 21 bp, Artificial Sequence
  Description of Artificial Sequence: Synthetic oligonucleotide
  Description of Combined DNA/RNA Molecule: Synthetic oligonucleotide
uuugaagccaaaguaauuutt

SEQ ID NO: 1261 - DNA, 21 bp, Artificial Sequence
  Description of Artificial Sequence: Synthetic oligonucleotide
  Description of Combined DNA/RNA Molecule: Synthetic oligonucleotide
uuccaccuagaaaugaugatt

SEQ ID NO: 1262 - DNA, 21 bp, Artificial Sequence
  Description of Artificial Sequence: Synthetic oligonucleotide
  Description of Combined DNA/RNA Molecule: Synthetic oligonucleotide
uaucaguccuggcaugguatt

SEQ ID NO: 1263 - DNA, 21 bp, Artificial Sequence
  Description of Artificial Sequence: Synthetic oligonucleotide
  Description of Combined DNA/RNA Molecule: Synthetic oligonucleotide
uggcucaccccuauaaucatt

SEQ ID NO: 1264 - DNA, 21 bp, Artificial Sequence
  Description of Artificial Sequence: Synthetic oligonucleotide
  Description of Combined DNA/RNA Molecule: Synthetic oligonucleotide
aucccagcacuuugggagatt

SEQ ID NO: 1265 - DNA, 21 bp, Artificial Sequence
  Description of Artificial Sequence: Synthetic oligonucleotide
  Description of Combined DNA/RNA Molecule: Synthetic oligonucleotide
cuaaggcaggagaauugcutt

SEQ ID NO: 1266 - DNA, 21 bp, Artificial Sequence
  Description of Artificial Sequence: Synthetic oligonucleotide
  Description of Combined DNA/RNA Molecule: Synthetic oligonucleotide
ugcuugagcccagcaguuutt

SEQ ID NO: 1267 - DNA, 21 bp, Artificial Sequence
  Description of Artificial Sequence: Synthetic oligonucleotide
  Description of Combined DNA/RNA Molecule: Synthetic oligonucleotide
uugagaccagccugggcaatt

SEQ ID NO: 1268 - DNA, 21 bp, Artificial Sequence
  Description of Artificial Sequence: Synthetic oligonucleotide
  Description of Combined DNA/RNA Molecule: Synthetic oligonucleotide
acauagagagcuccugucutt

SEQ ID NO: 1269 - DNA, 21 bp, Artificial Sequence
  Description of Artificial Sequence: Synthetic oligonucleotide
  Description of Combined DNA/RNA Molecule: Synthetic oligonucleotide
ucuuuaaaaaaaauuuuuutt

SEQ ID NO: 1270 - DNA, 21 bp, Artificial Sequence
  Description of Artificial Sequence: Synthetic oligonucleotide
  Description of Combined DNA/RNA Molecule: Synthetic oligonucleotide
uuaauuaguuggucuugautt

SEQ ID NO: 1271 - DNA, 21 bp, Artificial Sequence
  Description of Artificial Sequence: Synthetic oligonucleotide
  Description of Combined DNA/RNA Molecule: Synthetic oligonucleotide
uagugcaugccuguagucatt

SEQ ID NO: 1272 - DNA, 21 bp, Artificial Sequence
  Description of Artificial Sequence: Synthetic oligonucleotide
  Description of Combined DNA/RNA Molecule: Synthetic oligonucleotide
cccaacuacuugaaaggcutt

SEQ ID NO: 1273 - DNA, 21 bp, Artificial Sequence
  Description of Artificial Sequence: Synthetic oligonucleotide
  Description of Combined DNA/RNA Molecule: Synthetic oligonucleotide
cugagguggagagaucauutt

SEQ ID NO: 1274 - DNA, 21 bp, Artificial Sequence
  Description of Artificial Sequence: Synthetic oligonucleotide
  Description of Combined DNA/RNA Molecule: Synthetic oligonucleotide
uuugagcucaggagguugatt

SEQ ID NO: 1275 - DNA, 21 bp, Artificial Sequence
  Description of Artificial Sequence: Synthetic oligonucleotide
  Description of Combined DNA/RNA Molecule: Synthetic oligonucleotide
uugaggcugcagugagcuatt

SEQ ID NO: 1276 - DNA, 21 bp, Artificial Sequence
  Description of Artificial Sequence: Synthetic oligonucleotide
  Description of Combined DNA/RNA Molecule: Synthetic oligonucleotide
cuccugccugagcgacugatt

SEQ ID NO: 1277 - DNA, 21 bp, Artificial Sequence
  Description of Artificial Sequence: Synthetic oligonucleotide
  Description of Combined DNA/RNA Molecule: Synthetic oligonucleotide
ugagcaagaucuugucucutt

SEQ ID NO: 1278 - DNA, 21 bp, Artificial Sequence
  Description of Artificial Sequence: Synthetic oligonucleotide
  Description of Combined DNA/RNA Molecule: Synthetic oligonucleotide
ugaagaaaaaaaaagaaautt

SEQ ID NO: 1279 - DNA, 21 bp, Artificial Sequence
  Description of Artificial Sequence: Synthetic oligonucleotide
  Description of Combined DNA/RNA Molecule: Synthetic oligonucleotide
uaaaaaugcugcuaucaaatt

SEQ ID NO: 1280 - DNA, 21 bp, Artificial Sequence
  Description of Artificial Sequence: Synthetic oligonucleotide
  Description of Combined DNA/RNA Molecule: Synthetic oligonucleotide
aaaaucaagcccaaccagatt

SEQ ID NO: 1281 - DNA, 21 bp, Artificial Sequence
  Description of Artificial Sequence: Synthetic oligonucleotide
  Description of Combined DNA/RNA Molecule: Synthetic oligonucleotide
agagguagaagagccaagatt

SEQ ID NO: 1282 - DNA, 21 bp, Artificial Sequence
  Description of Artificial Sequence: Synthetic oligonucleotide
  Description of Combined DNA/RNA Molecule: Synthetic oligonucleotide
aagccuggguucucauccutt

SEQ ID NO: 1283 - DNA, 21 bp, Artificial Sequence
  Description of Artificial Sequence: Synthetic oligonucleotide
  Description of Combined DNA/RNA Molecule: Synthetic oligonucleotide
cuagcucugucucuucugutt

SEQ ID NO: 1284 - DNA, 21 bp, Artificial Sequence
  Description of Artificial Sequence: Synthetic oligonucleotide
  Description of Combined DNA/RNA Molecule: Synthetic oligonucleotide
uuggacugucaauuccccutt

SEQ ID NO: 1285 - DNA, 21 bp, Artificial Sequence
  Description of Artificial Sequence: Synthetic oligonucleotide
  Description of Combined DNA/RNA Molecule: Synthetic oligonucleotide
ccuuccugugauccauuuutt

SEQ ID NO: 1286 - DNA, 21 bp, Artificial Sequence
  Description of Artificial Sequence: Synthetic oligonucleotide
  Description of Combined DNA/RNA Molecule: Synthetic oligonucleotide
ucucacgucuucugcuuuatt

SEQ ID NO: 1287 - DNA, 21 bp, Artificial Sequence
  Description of Artificial Sequence: Synthetic oligonucleotide
  Description of Combined DNA/RNA Molecule: Synthetic oligonucleotide
uaugaccugaaaacuccaatt

SEQ ID NO: 1288 - DNA, 21 bp, Artificial Sequence
  Description of Artificial Sequence: Synthetic oligonucleotide
  Description of Combined DNA/RNA Molecule: Synthetic oligonucleotide
uuacauaaaggaucugcaatt

SEQ ID NO: 1289 - DNA, 21 bp, Artificial Sequence
  Description of Artificial Sequence: Synthetic oligonucleotide
  Description of Combined DNA/RNA Molecule: Synthetic oligonucleotide
cagcuaucuaaggcuuggutt

SEQ ID NO: 1290 - DNA, 21 bp, Artificial Sequence
  Description of Artificial Sequence: Synthetic oligonucleotide
  Description of Combined DNA/RNA Molecule: Synthetic oligonucleotide
augauaccugggucuaauatt

SEQ ID NO: 1291 - DNA, 21 bp, Artificial Sequence
  Description of Artificial Sequence: Synthetic oligonucleotide
  Description of Combined DNA/RNA Molecule: Synthetic oligonucleotide
aacucugcugagaucaccutt

SEQ ID NO: 1292 - DNA, 21 bp, Artificial Sequence
  Description of Artificial Sequence: Synthetic oligonucleotide
  Description of Combined DNA/RNA Molecule: Synthetic oligonucleotide
accucaaguuucugcgguutt

SEQ ID NO: 1293 - DNA, 21 bp, Artificial Sequence
  Description of Artificial Sequence: Synthetic oligonucleotide
  Description of Combined DNA/RNA Molecule: Synthetic oligonucleotide
uugguaaagagaacaaggatt

SEQ ID NO: 1294 - DNA, 21 bp, Artificial Sequence
  Description of Artificial Sequence: Synthetic oligonucleotide
  Description of Combined DNA/RNA Molecule: Synthetic oligonucleotide
aagaacaaacaucccuuuutt

SEQ ID NO: 1295 - DNA, 21 bp, Artificial Sequence
  Description of Artificial Sequence: Synthetic oligonucleotide
  Description of Combined DNA/RNA Molecule: Synthetic oligonucleotide
uuuuauugcuccaaauggutt

SEQ ID NO: 1296 - DNA, 21 bp, Artificial Sequence
  Description of Artificial Sequence: Synthetic oligonucleotide
  Description of Combined DNA/RNA Molecule: Synthetic oligonucleotide
gauuuaaucccuacauggutt

SEQ ID NO: 1297 - DNA, 21 bp, Artificial Sequence
  Description of Artificial Sequence: Synthetic oligonucleotide
  Description of Combined DNA/RNA Molecule: Synthetic oligonucleotide
ggugcuggguggacaaugutt

SEQ ID NO: 1298 - DNA, 21 bp, Artificial Sequence
  Description of Artificial Sequence: Synthetic oligonucleotide
  Description of Combined DNA/RNA Molecule: Synthetic oligonucleotide
ugucacugucacaugccuutt

SEQ ID NO: 1299 - DNA, 21 bp, Artificial Sequence
  Description of Artificial Sequence: Synthetic oligonucleotide
  Description of Combined DNA/RNA Molecule: Synthetic oligonucleotide
uucacuguauaaauccaaatt

SEQ ID NO: 1300 - DNA, 21 bp, Artificial Sequence
  Description of Artificial Sequence: Synthetic oligonucleotide
  Description of Combined DNA/RNA Molecule: Synthetic oligonucleotide
accuucugccagagagaautt

SEQ ID NO: 1301 - DNA, 21 bp, Artificial Sequence
  Description of Artificial Sequence: Synthetic oligonucleotide
  Description of Combined DNA/RNA Molecule: Synthetic oligonucleotide
cauggagggaggauagugatt

SEQ ID NO: 1302 - DNA, 21 bp, Artificial Sequence
  Description of Artificial Sequence: Synthetic oligonucleotide
  Description of Combined DNA/RNA Molecule: Synthetic oligonucleotide
aaaugauauaguuggacuatt

SEQ ID NO: 1303 - DNA, 21 bp, Artificial Sequence
  Description of Artificial Sequence: Synthetic oligonucleotide
  Description of Combined DNA/RNA Molecule: Synthetic oligonucleotide
acuggugcuugaugucacutt

SEQ ID NO: 1304 - DNA, 21 bp, Artificial Sequence
  Description of Artificial Sequence: Synthetic oligonucleotide
  Description of Combined DNA/RNA Molecule: Synthetic oligonucleotide
cuaauaaaugaaacugucatt

SEQ ID NO: 1305 - DNA, 21 bp, Artificial Sequence
  Description of Artificial Sequence: Synthetic oligonucleotide
  Description of Combined DNA/RNA Molecule: Synthetic oligonucleotide
agagacacuggcagguagutt

SEQ ID NO: 1306 - DNA, 21 bp, Artificial Sequence
  Description of Artificial Sequence: Synthetic oligonucleotide
  Description of Combined DNA/RNA Molecule: Synthetic oligonucleotide
ucagguaccucacuccuaatt

SEQ ID NO: 1307 - DNA, 21 bp, Artificial Sequence
  Description of Artificial Sequence: Synthetic oligonucleotide
  Description of Combined DNA/RNA Molecule: Synthetic oligonucleotide
ucugucauugucacagguutt

SEQ ID NO: 1308 - DNA, 21 bp, Artificial Sequence
  Description of Artificial Sequence: Synthetic oligonucleotide
  Description of Combined DNA/RNA Molecule: Synthetic oligonucleotide
agaaaaccaauuugucugctt

SEQ ID NO: 1309 - DNA, 21 bp, Artificial Sequence
  Description of Artificial Sequence: Synthetic oligonucleotide
  Description of Combined DNA/RNA Molecule: Synthetic oligonucleotide
ucuuucugccauucacaaatt

SEQ ID NO: 1310 - DNA, 21 bp, Artificial Sequence
  Description of Artificial Sequence: Synthetic oligonucleotide
  Description of Combined DNA/RNA Molecule: Synthetic oligonucleotide
uauuuuucuccaccaccuutt

SEQ ID NO: 1311 - DNA, 21 bp, Artificial Sequence
  Description of Artificial Sequence: Synthetic oligonucleotide
  Description of Combined DNA/RNA Molecule: Synthetic oligonucleotide
ucucagguaggccaaaaggtt

SEQ ID NO: 1312 - DNA, 21 bp, Artificial Sequence
  Description of Artificial Sequence: Synthetic oligonucleotide
  Description of Combined DNA/RNA Molecule: Synthetic oligonucleotide
acucagccccaacuuucuutt

SEQ ID NO: 1313 - DNA, 21 bp, Artificial Sequence
  Description of Artificial Sequence: Synthetic oligonucleotide
  Description of Combined DNA/RNA Molecule: Synthetic oligonucleotide
agccgagcuugguuccacutt

SEQ ID NO: 1314 - DNA, 21 bp, Artificial Sequence
  Description of Artificial Sequence: Synthetic oligonucleotide
  Description of Combined DNA/RNA Molecule: Synthetic oligonucleotide
ucagccccccucuccacagtt

SEQ ID NO: 1315 - DNA, 21 bp, Artificial Sequence
  Description of Artificial Sequence: Synthetic oligonucleotide
  Description of Combined DNA/RNA Molecule: Synthetic oligonucleotide
uaucacugugcaagccccgtt

SEQ ID NO: 1316 - DNA, 21 bp, Artificial Sequence
  Description of Artificial Sequence: Synthetic oligonucleotide
  Description of Combined DNA/RNA Molecule: Synthetic oligonucleotide
uaucauacuuggagagcautt

SEQ ID NO: 1317 - DNA, 21 bp, Artificial Sequence
  Description of Artificial Sequence: Synthetic oligonucleotide
  Description of Combined DNA/RNA Molecule: Synthetic oligonucleotide
uuggcagaaaaguggacgatt

SEQ ID NO: 1318 - DNA, 21 bp, Artificial Sequence
  Description of Artificial Sequence: Synthetic oligonucleotide
  Description of Combined DNA/RNA Molecule: Synthetic oligonucleotide
augggggccaggcaggcautt

SEQ ID NO: 1319 - DNA, 21 bp, Artificial Sequence
  Description of Artificial Sequence: Synthetic oligonucleotide
  Description of Combined DNA/RNA Molecule: Synthetic oligonucleotide
uauggugcaaggagcagautt

SEQ ID NO: 1320 - DNA, 21 bp, Artificial Sequence
  Description of Artificial Sequence: Synthetic oligonucleotide
  Description of Combined DNA/RNA Molecule: Synthetic oligonucleotide
uacaguugucacugcaacatt

SEQ ID NO: 1321 - DNA, 21 bp, Artificial Sequence
  Description of Artificial Sequence: Synthetic oligonucleotide
  Description of Combined DNA/RNA Molecule: Synthetic oligonucleotide
uugcuuccuauuccuuccatt

SEQ ID NO: 1322 - DNA, 21 bp, Artificial Sequence
  Description of Artificial Sequence: Synthetic oligonucleotide
  Description of Combined DNA/RNA Molecule: Synthetic oligonucleotide
augcagccucgucuuggugtt

SEQ ID NO: 1323 - DNA, 21 bp, Artificial Sequence
  Description of Artificial Sequence: Synthetic oligonucleotide
  Description of Combined DNA/RNA Molecule: Synthetic oligonucleotide
aauucucuccugcacaggatt

SEQ ID NO: 1324 - DNA, 21 bp, Artificial Sequence
  Description of Artificial Sequence: Synthetic oligonucleotide
  Description of Combined DNA/RNA Molecule: Synthetic oligonucleotide
agccguggcuuuuggcaautt

SEQ ID NO: 1325 - DNA, 21 bp, Artificial Sequence
  Description of Artificial Sequence: Synthetic oligonucleotide
  Description of Combined DNA/RNA Molecule: Synthetic oligonucleotide
ugcagaacccgcacugggatt

SEQ ID NO: 1326 - DNA, 21 bp, Artificial Sequence
  Description of Artificial Sequence: Synthetic oligonucleotide
  Description of Combined DNA/RNA Molecule: Synthetic oligonucleotide
ugacgaugccaggggugcatt

SEQ ID NO: 1327 - DNA, 21 bp, Artificial Sequence
  Description of Artificial Sequence: Synthetic oligonucleotide
  Description of Combined DNA/RNA Molecule: Synthetic oligonucleotide
agcaguguguacauacucatt

SEQ ID NO: 1328 - DNA, 21 bp, Artificial Sequence
  Description of Artificial Sequence: Synthetic oligonucleotide
  Description of Combined DNA/RNA Molecule: Synthetic oligonucleotide
ucgggcugauuccggagcatt

SEQ ID NO: 1329 - DNA, 21 bp, Artificial Sequence
  Description of Artificial Sequence: Synthetic oligonucleotide
  Description of Combined DNA/RNA Molecule: Synthetic oligonucleotide
aucuccuccauggugggcutt

SEQ ID NO: 1330 - DNA, 21 bp, Artificial Sequence
  Description of Artificial Sequence: Synthetic oligonucleotide
  Description of Combined DNA/RNA Molecule: Synthetic oligonucleotide
ucuuggaaggcauucucaatt

SEQ ID NO: 1331 - DNA, 21 bp, Artificial Sequence
  Description of Artificial Sequence: Synthetic oligonucleotide
  Description of Combined DNA/RNA Molecule: Synthetic oligonucleotide
uagcggcacagauuuccuutt

SEQ ID NO: 1332 - DNA, 21 bp, Artificial Sequence
  Description of Artificial Sequence: Synthetic oligonucleotide
  Description of Combined DNA/RNA Molecule: Synthetic oligonucleotide
uaugggucuguagccugugtt

SEQ ID NO: 1333 - DNA, 21 bp, Artificial Sequence
  Description of Artificial Sequence: Synthetic oligonucleotide
  Description of Combined DNA/RNA Molecule: Synthetic oligonucleotide
ucggaagcccuggaggaugtt

SEQ ID NO: 1334 - DNA, 21 bp, Artificial Sequence
  Description of Artificial Sequence: Synthetic oligonucleotide
  Description of Combined DNA/RNA Molecule: Synthetic oligonucleotide
uaccaucccuggcaaaggutt

SEQ ID NO: 1335 - DNA, 21 bp, Artificial Sequence
  Description of Artificial Sequence: Synthetic oligonucleotide
  Description of Combined DNA/RNA Molecule: Synthetic oligonucleotide
aucuccuccacagcauccatt

SEQ ID NO: 1336 - DNA, 21 bp, Artificial Sequence
  Description of Artificial Sequence: Synthetic oligonucleotide
  Description of Combined DNA/RNA Molecule: Synthetic oligonucleotide
aauuuggauuauucccauctt

SEQ ID NO: 1337 - DNA, 21 bp, Artificial Sequence
  Description of Artificial Sequence: Synthetic oligonucleotide
  Description of Combined DNA/RNA Molecule: Synthetic oligonucleotide
uugacugaguggucuuucutt

SEQ ID NO: 1338 - DNA, 21 bp, Artificial Sequence
  Description of Artificial Sequence: Synthetic oligonucleotide
  Description of Combined DNA/RNA Molecule: Synthetic oligonucleotide
auaaagauggcgagaggcutt

SEQ ID NO: 1339 - DNA, 21 bp, Artificial Sequence
  Description of Artificial Sequence: Synthetic oligonucleotide
  Description of Combined DNA/RNA Molecule: Synthetic oligonucleotide
aacuccucugguuugaauatt

SEQ ID NO: 1340 - DNA, 21 bp, Artificial Sequence
  Description of Artificial Sequence: Synthetic oligonucleotide
  Description of Combined DNA/RNA Molecule: Synthetic oligonucleotide
uuggauccaggggcgugaatt

SEQ ID NO: 1341 - DNA, 21 bp, Artificial Sequence
  Description of Artificial Sequence: Synthetic oligonucleotide
  Description of Combined DNA/RNA Molecule: Synthetic oligonucleotide
aaaaaugggcuccuggguutt

SEQ ID NO: 1342 - DNA, 21 bp, Artificial Sequence
  Description of Artificial Sequence: Synthetic oligonucleotide
  Description of Combined DNA/RNA Molecule: Synthetic oligonucleotide
uucagcaacucugggggaatt

SEQ ID NO: 1343 - DNA, 21 bp, Artificial Sequence
  Description of Artificial Sequence: Synthetic oligonucleotide
  Description of Combined DNA/RNA Molecule: Synthetic oligonucleotide
uaggagugucuuucagccutt

SEQ ID NO: 1344 - DNA, 21 bp, Artificial Sequence
  Description of Artificial Sequence: Synthetic oligonucleotide
  Description of Combined DNA/RNA Molecule: Synthetic oligonucleotide
aaaucgcagcugcuuccgatt

SEQ ID NO: 1345 - DNA, 21 bp, Artificial Sequence
  Description of Artificial Sequence: Synthetic oligonucleotide
  Description of Combined DNA/RNA Molecule: Synthetic oligonucleotide
uucacacgcuccccuucaatt

SEQ ID NO: 1346 - DNA, 21 bp, Artificial Sequence
  Description of Artificial Sequence: Synthetic oligonucleotide
  Description of Combined DNA/RNA Molecule: Synthetic oligonucleotide
uuugaggccuguauccacgtt

SEQ ID NO: 1347 - DNA, 21 bp, Artificial Sequence
  Description of Artificial Sequence: Synthetic oligonucleotide
  Description of Combined DNA/RNA Molecule: Synthetic oligonucleotide
uagcagcuccuugaggguutt

SEQ ID NO: 1348 - DNA, 21 bp, Artificial Sequence
  Description of Artificial Sequence: Synthetic oligonucleotide
  Description of Combined DNA/RNA Molecule: Synthetic oligonucleotide
ugcugagccuugagguccatt

SEQ ID NO: 1349 - DNA, 21 bp, Artificial Sequence
  Description of Artificial Sequence: Synthetic oligonucleotide
  Description of Combined DNA/RNA Molecule: Synthetic oligonucleotide
accagcuuggcgucagggutt

SEQ ID NO: 1350 - DNA, 21 bp, Artificial Sequence
  Description of Artificial Sequence: Synthetic oligonucleotide
  Description of Combined DNA/RNA Molecule: Synthetic oligonucleotide
aucuccguguuccccacgatt

SEQ ID NO: 1351 - DNA, 21 bp, Artificial Sequence
  Description of Artificial Sequence: Synthetic oligonucleotide
  Description of Combined DNA/RNA Molecule: Synthetic oligonucleotide
acuucaucucaaugccaautt

SEQ ID NO: 1352 - DNA, 21 bp, Artificial Sequence
  Description of Artificial Sequence: Synthetic oligonucleotide
  Description of Combined DNA/RNA Molecule: Synthetic oligonucleotide
acagcauauucuugaacuutt

SEQ ID NO: 1353 - DNA, 21 bp, Artificial Sequence
  Description of Artificial Sequence: Synthetic oligonucleotide
  Description of Combined DNA/RNA Molecule: Synthetic oligonucleotide
ugcagacaaucauaggaaatt

SEQ ID NO: 1354 - DNA, 21 bp, Artificial Sequence
  Description of Artificial Sequence: Synthetic oligonucleotide
  Description of Combined DNA/RNA Molecule: Synthetic oligonucleotide
uucagggauccaggcugggtt

SEQ ID NO: 1355 - DNA, 21 bp, Artificial Sequence
  Description of Artificial Sequence: Synthetic oligonucleotide
  Description of Combined DNA/RNA Molecule: Synthetic oligonucleotide
uguucuaccgaauucagcutt

SEQ ID NO: 1356 - DNA, 21 bp, Artificial Sequence
  Description of Artificial Sequence: Synthetic oligonucleotide
  Description of Combined DNA/RNA Molecule: Synthetic oligonucleotide
agauaccgucggguccaugtt

SEQ ID NO: 1357 - DNA, 21 bp, Artificial Sequence
  Description of Artificial Sequence: Synthetic oligonucleotide
  Description of Combined DNA/RNA Molecule: Synthetic oligonucleotide
uaagcagcuccaaaggagatt

SEQ ID NO: 1358 - DNA, 21 bp, Artificial Sequence
  Description of Artificial Sequence: Synthetic oligonucleotide
  Description of Combined DNA/RNA Molecule: Synthetic oligonucleotide
ucacaaugcucagggggcatt

SEQ ID NO: 1359 - DNA, 21 bp, Artificial Sequence
  Description of Artificial Sequence: Synthetic oligonucleotide
  Description of Combined DNA/RNA Molecule: Synthetic oligonucleotide
ucauccaccaggguuuuuutt

SEQ ID NO: 1360 - DNA, 21 bp, Artificial Sequence
  Description of Artificial Sequence: Synthetic oligonucleotide
  Description of Combined DNA/RNA Molecule: Synthetic oligonucleotide
aggaagcuuagcaacagcatt

SEQ ID NO: 1361 - DNA, 21 bp, Artificial Sequence
  Description of Artificial Sequence: Synthetic oligonucleotide
  Description of Combined DNA/RNA Molecule: Synthetic oligonucleotide
ucucugucuuuugggcaggtt

SEQ ID NO: 1362 - DNA, 21 bp, Artificial Sequence
  Description of Artificial Sequence: Synthetic oligonucleotide
  Description of Combined DNA/RNA Molecule: Synthetic oligonucleotide
uccaggaccccucugaacatt

SEQ ID NO: 1363 - DNA, 21 bp, Artificial Sequence
  Description of Artificial Sequence: Synthetic oligonucleotide
  Description of Combined DNA/RNA Molecule: Synthetic oligonucleotide
aaccagcgcagcugcuccatt

SEQ ID NO: 1364 - DNA, 21 bp, Artificial Sequence
  Description of Artificial Sequence: Synthetic oligonucleotide
  Description of Combined DNA/RNA Molecule: Synthetic oligonucleotide
ugacuugcuucccagcaaatt

SEQ ID NO: 1365 - DNA, 21 bp, Artificial Sequence
  Description of Artificial Sequence: Synthetic oligonucleotide
  Description of Combined DNA/RNA Molecule: Synthetic oligonucleotide
aacggacgccacagacuugtt

SEQ ID NO: 1366 - DNA, 21 bp, Artificial Sequence
  Description of Artificial Sequence: Synthetic oligonucleotide
  Description of Combined DNA/RNA Molecule: Synthetic oligonucleotide
agugaugauguucccuccatt

SEQ ID NO: 1367 - DNA, 21 bp, Artificial Sequence
  Description of Artificial Sequence: Synthetic oligonucleotide
  Description of Combined DNA/RNA Molecule: Synthetic oligonucleotide
uucggagauggggcuggcatt

SEQ ID NO: 1368 - DNA, 21 bp, Artificial Sequence
  Description of Artificial Sequence: Synthetic oligonucleotide
  Description of Combined DNA/RNA Molecule: Synthetic oligonucleotide
augaacacgggguugaggutt

SEQ ID NO: 1369 - DNA, 21 bp, Artificial Sequence
  Description of Artificial Sequence: Synthetic oligonucleotide
  Description of Combined DNA/RNA Molecule: Synthetic oligonucleotide
uuggccccacuggccaugatt

SEQ ID NO: 1370 - DNA, 21 bp, Artificial Sequence
  Description of Artificial Sequence: Synthetic oligonucleotide
  Description of Combined DNA/RNA Molecule: Synthetic oligonucleotide
uggacacaagugucagcuutt

SEQ ID NO: 1371 - DNA, 21 bp, Artificial Sequence
  Description of Artificial Sequence: Synthetic oligonucleotide
  Description of Combined DNA/RNA Molecule: Synthetic oligonucleotide
aguucuccuggugccucugtt

SEQ ID NO: 1372 - DNA, 21 bp, Artificial Sequence
  Description of Artificial Sequence: Synthetic oligonucleotide
  Description of Combined DNA/RNA Molecule: Synthetic oligonucleotide
ugugugguccaucuggacatt

SEQ ID NO: 1373 - DNA, 21 bp, Artificial Sequence
  Description of Artificial Sequence: Synthetic oligonucleotide
  Description of Combined DNA/RNA Molecule: Synthetic oligonucleotide
uuguagccagggaagaaggtt

SEQ ID NO: 1374 - DNA, 21 bp, Artificial Sequence
  Description of Artificial Sequence: Synthetic oligonucleotide
  Description of Combined DNA/RNA Molecule: Synthetic oligonucleotide
ugcucagcagggucuuucutt

SEQ ID NO: 1375 - DNA, 21 bp, Artificial Sequence
  Description of Artificial Sequence: Synthetic oligonucleotide
  Description of Combined DNA/RNA Molecule: Synthetic oligonucleotide
agagcaguaucuccuccggtt

SEQ ID NO: 1376 - DNA, 21 bp, Artificial Sequence
  Description of Artificial Sequence: Synthetic oligonucleotide
  Description of Combined DNA/RNA Molecule: Synthetic oligonucleotide
aggggaucucuauggagagtt

SEQ ID NO: 1377 - DNA, 21 bp, Artificial Sequence
  Description of Artificial Sequence: Synthetic oligonucleotide
  Description of Combined DNA/RNA Molecule: Synthetic oligonucleotide
acucccccucccugcuguatt

SEQ ID NO: 1378 - DNA, 21 bp, Artificial Sequence
  Description of Artificial Sequence: Synthetic oligonucleotide
  Description of Combined DNA/RNA Molecule: Synthetic oligonucleotide
uugaaugcugagaaauacutt

SEQ ID NO: 1379 - DNA, 21 bp, Artificial Sequence
  Description of Artificial Sequence: Synthetic oligonucleotide
  Description of Combined DNA/RNA Molecule: Synthetic oligonucleotide
uucuccgggaggccugcuutt

SEQ ID NO: 1380 - DNA, 21 bp, Artificial Sequence
  Description of Artificial Sequence: Synthetic oligonucleotide
  Description of Combined DNA/RNA Molecule: Synthetic oligonucleotide
accuuggcaaugucaucuutt

SEQ ID NO: 1381 - DNA, 21 bp, Artificial Sequence
  Description of Artificial Sequence: Synthetic oligonucleotide
  Description of Combined DNA/RNA Molecule: Synthetic oligonucleotide
ucucaugccacugguuacctt

SEQ ID NO: 1382 - DNA, 21 bp, Artificial Sequence
  Description of Artificial Sequence: Synthetic oligonucleotide
  Description of Combined DNA/RNA Molecule: Synthetic oligonucleotide
uuggcuugaauaaaacucutt

SEQ ID NO: 1383 - DNA, 21 bp, Artificial Sequence
  Description of Artificial Sequence: Synthetic oligonucleotide
  Description of Combined DNA/RNA Molecule: Synthetic oligonucleotide
uuguaccucugugguuccutt

SEQ ID NO: 1384 - DNA, 21 bp, Artificial Sequence
  Description of Artificial Sequence: Synthetic oligonucleotide
  Description of Combined DNA/RNA Molecule: Synthetic oligonucleotide
uagcaaagggccagcuccutt

SEQ ID NO: 1385 - DNA, 21 bp, Artificial Sequence
  Description of Artificial Sequence: Synthetic oligonucleotide
  Description of Combined DNA/RNA Molecule: Synthetic oligonucleotide
uguuggccauuccaccauatt

SEQ ID NO: 1386 - DNA, 21 bp, Artificial Sequence
  Description of Artificial Sequence: Synthetic oligonucleotide
  Description of Combined DNA/RNA Molecule: Synthetic oligonucleotide
ugagggcugagaugguucutt

SEQ ID NO: 1387 - DNA, 21 bp, Artificial Sequence
  Description of Artificial Sequence: Synthetic oligonucleotide
  Description of Combined DNA/RNA Molecule: Synthetic oligonucleotide
ucugccucugaguggucuutt

SEQ ID NO: 1388 - DNA, 21 bp, Artificial Sequence
  Description of Artificial Sequence: Synthetic oligonucleotide
  Description of Combined DNA/RNA Molecule: Synthetic oligonucleotide
uccagagcuuggaaagcugtt

SEQ ID NO: 1389 - DNA, 21 bp, Artificial Sequence
  Description of Artificial Sequence: Synthetic oligonucleotide
  Description of Combined DNA/RNA Molecule: Synthetic oligonucleotide
uccugcagcagcuccuccutt

SEQ ID NO: 1390 - DNA, 21 bp, Artificial Sequence
  Description of Artificial Sequence: Synthetic oligonucleotide
  Description of Combined DNA/RNA Molecule: Synthetic oligonucleotide
aguccugcacacacguccutt

SEQ ID NO: 1391 - DNA, 21 bp, Artificial Sequence
  Description of Artificial Sequence: Synthetic oligonucleotide
  Description of Combined DNA/RNA Molecule: Synthetic oligonucleotide
agaugcagcuccucugccatt

SEQ ID NO: 1392 - DNA, 21 bp, Artificial Sequence
  Description of Artificial Sequence: Synthetic oligonucleotide
  Description of Combined DNA/RNA Molecule: Synthetic oligonucleotide
aggggcaucgggaggcagatt

SEQ ID NO: 1393 - DNA, 21 bp, Artificial Sequence
  Description of Artificial Sequence: Synthetic oligonucleotide
  Description of Combined DNA/RNA Molecule: Synthetic oligonucleotide
ugaaguccaccaugccacctt

SEQ ID NO: 1394 - DNA, 21 bp, Artificial Sequence
  Description of Artificial Sequence: Synthetic oligonucleotide
  Description of Combined DNA/RNA Molecule: Synthetic oligonucleotide
uggugagggugcaccggaatt

SEQ ID NO: 1395 - DNA, 21 bp, Artificial Sequence
  Description of Artificial Sequence: Synthetic oligonucleotide
  Description of Combined DNA/RNA Molecule: Synthetic oligonucleotide
aacuugaagaagaagcugatt

SEQ ID NO: 1396 - DNA, 21 bp, Artificial Sequence
  Description of Artificial Sequence: Synthetic oligonucleotide
  Description of Combined DNA/RNA Molecule: Synthetic oligonucleotide
uaaggacugucagguagaatt

SEQ ID NO: 1397 - DNA, 21 bp, Artificial Sequence
  Description of Artificial Sequence: Synthetic oligonucleotide
  Description of Combined DNA/RNA Molecule: Synthetic oligonucleotide
acuugucuuccagguucuctt

SEQ ID NO: 1398 - DNA, 21 bp, Artificial Sequence
  Description of Artificial Sequence: Synthetic oligonucleotide
  Description of Combined DNA/RNA Molecule: Synthetic oligonucleotide
ugggguccaguuuaccacatt

SEQ ID NO: 1399 - DNA, 21 bp, Artificial Sequence
  Description of Artificial Sequence: Synthetic oligonucleotide
  Description of Combined DNA/RNA Molecule: Synthetic oligonucleotide
aguugcacuggcgaaagugtt

SEQ ID NO: 1400 - DNA, 21 bp, Artificial Sequence
  Description of Artificial Sequence: Synthetic oligonucleotide
  Description of Combined DNA/RNA Molecule: Synthetic oligonucleotide
cuuucugaaacaguaaagutt

SEQ ID NO: 1401 - DNA, 21 bp, Artificial Sequence
  Description of Artificial Sequence: Synthetic oligonucleotide
  Description of Combined DNA/RNA Molecule: Synthetic oligonucleotide
acaucggcuggggggucuutt

SEQ ID NO: 1402 - DNA, 21 bp, Artificial Sequence
  Description of Artificial Sequence: Synthetic oligonucleotide
  Description of Combined DNA/RNA Molecule: Synthetic oligonucleotide
accucuuggaagagcuggatt

SEQ ID NO: 1403 - DNA, 21 bp, Artificial Sequence
  Description of Artificial Sequence: Synthetic oligonucleotide
  Description of Combined DNA/RNA Molecule: Synthetic oligonucleotide
ucagacugacccuugggcatt

SEQ ID NO: 1404 - DNA, 21 bp, Artificial Sequence
  Description of Artificial Sequence: Synthetic oligonucleotide
  Description of Combined DNA/RNA Molecule: Synthetic oligonucleotide
ugcccaccauguccuccuctt

SEQ ID NO: 1405 - DNA, 21 bp, Artificial Sequence
  Description of Artificial Sequence: Synthetic oligonucleotide
  Description of Combined DNA/RNA Molecule: Synthetic oligonucleotide
agguggggcaggggccggctt

SEQ ID NO: 1406 - DNA, 21 bp, Artificial Sequence
  Description of Artificial Sequence: Synthetic oligonucleotide
  Description of Combined DNA/RNA Molecule: Synthetic oligonucleotide
uugcauguccgcugccaggtt

SEQ ID NO: 1407 - DNA, 21 bp, Artificial Sequence
  Description of Artificial Sequence: Synthetic oligonucleotide
  Description of Combined DNA/RNA Molecule: Synthetic oligonucleotide
acggccucaccagaggccutt

SEQ ID NO: 1408 - DNA, 21 bp, Artificial Sequence
  Description of Artificial Sequence: Synthetic oligonucleotide
  Description of Combined DNA/RNA Molecule: Synthetic oligonucleotide
ugaaugucgucacaguacatt

SEQ ID NO: 1409 - DNA, 21 bp, Artificial Sequence
  Description of Artificial Sequence: Synthetic oligonucleotide
  Description of Combined DNA/RNA Molecule: Synthetic oligonucleotide
agcucauucucguagcgagtt

SEQ ID NO: 1410 - DNA, 21 bp, Artificial Sequence
  Description of Artificial Sequence: Synthetic oligonucleotide
  Description of Combined DNA/RNA Molecule: Synthetic oligonucleotide
ugaccagccggagagacagtt

SEQ ID NO: 1411 - DNA, 21 bp, Artificial Sequence
  Description of Artificial Sequence: Synthetic oligonucleotide
  Description of Combined DNA/RNA Molecule: Synthetic oligonucleotide
ugacuugaucuuggcguggtt

SEQ ID NO: 1412 - DNA, 21 bp, Artificial Sequence
  Description of Artificial Sequence: Synthetic oligonucleotide
  Description of Combined DNA/RNA Molecule: Synthetic oligonucleotide
agcuucugauguaucuaugtt

SEQ ID NO: 1413 - DNA, 21 bp, Artificial Sequence
  Description of Artificial Sequence: Synthetic oligonucleotide
  Description of Combined DNA/RNA Molecule: Synthetic oligonucleotide
uggaaaugaaacaaacaaatt

SEQ ID NO: 1414 - DNA, 21 bp, Artificial Sequence
  Description of Artificial Sequence: Synthetic oligonucleotide
  Description of Combined DNA/RNA Molecule: Synthetic oligonucleotide
ucccaggaacaucaucagctt

SEQ ID NO: 1415 - DNA, 21 bp, Artificial Sequence
  Description of Artificial Sequence: Synthetic oligonucleotide
  Description of Combined DNA/RNA Molecule: Synthetic oligonucleotide
uuauccuucgcaaagacugtt

SEQ ID NO: 1416 - DNA, 21 bp, Artificial Sequence
  Description of Artificial Sequence: Synthetic oligonucleotide
  Description of Combined DNA/RNA Molecule: Synthetic oligonucleotide
ucccaacacaaguaaccuutt

SEQ ID NO: 1417 - DNA, 21 bp, Artificial Sequence
  Description of Artificial Sequence: Synthetic oligonucleotide
  Description of Combined DNA/RNA Molecule: Synthetic oligonucleotide
ucacagcaccaaugauaugtt

SEQ ID NO: 1418 - DNA, 21 bp, Artificial Sequence
  Description of Artificial Sequence: Synthetic oligonucleotide
  Description of Combined DNA/RNA Molecule: Synthetic oligonucleotide
uccggggugucagcaaccatt

SEQ ID NO: 1419 - DNA, 21 bp, Artificial Sequence
  Description of Artificial Sequence: Synthetic oligonucleotide
  Description of Combined DNA/RNA Molecule: Synthetic oligonucleotide
ugcagcucucugugugugutt

SEQ ID NO: 1420 - DNA, 21 bp, Artificial Sequence
  Description of Artificial Sequence: Synthetic oligonucleotide
  Description of Combined DNA/RNA Molecule: Synthetic oligonucleotide
ugauuuucaccccuugggctt

SEQ ID NO: 1421 - DNA, 21 bp, Artificial Sequence
  Description of Artificial Sequence: Synthetic oligonucleotide
  Description of Combined DNA/RNA Molecule: Synthetic oligonucleotide
uguaguucuucauaggugatt

SEQ ID NO: 1422 - DNA, 21 bp, Artificial Sequence
  Description of Artificial Sequence: Synthetic oligonucleotide
  Description of Combined DNA/RNA Molecule: Synthetic oligonucleotide
uguucuuuauagcauccuctt

SEQ ID NO: 1423 - DNA, 21 bp, Artificial Sequence
  Description of Artificial Sequence: Synthetic oligonucleotide
  Description of Combined DNA/RNA Molecule: Synthetic oligonucleotide
agguccauaaaaggaguugtt

SEQ ID NO: 1424 - DNA, 21 bp, Artificial Sequence
  Description of Artificial Sequence: Synthetic oligonucleotide
  Description of Combined DNA/RNA Molecule: Synthetic oligonucleotide
ucucgaucuucagcucaggtt

SEQ ID NO: 1425 - DNA, 21 bp, Artificial Sequence
  Description of Artificial Sequence: Synthetic oligonucleotide
  Description of Combined DNA/RNA Molecule: Synthetic oligonucleotide
ucuucuuuagguccccuuutt

SEQ ID NO: 1426 - DNA, 21 bp, Artificial Sequence
  Description of Artificial Sequence: Synthetic oligonucleotide
  Description of Combined DNA/RNA Molecule: Synthetic oligonucleotide
ucugcuucggaaaaccccutt

SEQ ID NO: 1427 - DNA, 21 bp, Artificial Sequence
  Description of Artificial Sequence: Synthetic oligonucleotide
  Description of Combined DNA/RNA Molecule: Synthetic oligonucleotide
uuccccugacacaacauuatt

SEQ ID NO: 1428 - DNA, 21 bp, Artificial Sequence
  Description of Artificial Sequence: Synthetic oligonucleotide
  Description of Combined DNA/RNA Molecule: Synthetic oligonucleotide
uggccaccgauguauaucutt

SEQ ID NO: 1429 - DNA, 21 bp, Artificial Sequence
  Description of Artificial Sequence: Synthetic oligonucleotide
  Description of Combined DNA/RNA Molecule: Synthetic oligonucleotide
agguagaagugcucuuggctt

SEQ ID NO: 1430 - DNA, 21 bp, Artificial Sequence
  Description of Artificial Sequence: Synthetic oligonucleotide
  Description of Combined DNA/RNA Molecule: Synthetic oligonucleotide
aauggugcagugagucucctt

SEQ ID NO: 1431 - DNA, 21 bp, Artificial Sequence
  Description of Artificial Sequence: Synthetic oligonucleotide
  Description of Combined DNA/RNA Molecule: Synthetic oligonucleotide
ucgccuuuuggaacagcaatt

SEQ ID NO: 1432 - DNA, 21 bp, Artificial Sequence
  Description of Artificial Sequence: Synthetic oligonucleotide
  Description of Combined DNA/RNA Molecule: Synthetic oligonucleotide
uuccaucuccccugccucgtt

SEQ ID NO: 1433 - DNA, 21 bp, Artificial Sequence
  Description of Artificial Sequence: Synthetic oligonucleotide
  Description of Combined DNA/RNA Molecule: Synthetic oligonucleotide
uguguagacacaaagagcutt

SEQ ID NO: 1434 - DNA, 21 bp, Artificial Sequence
  Description of Artificial Sequence: Synthetic oligonucleotide
  Description of Combined DNA/RNA Molecule: Synthetic oligonucleotide
uggucuucaugguguucugtt

SEQ ID NO: 1435 - DNA, 21 bp, Artificial Sequence
  Description of Artificial Sequence: Synthetic oligonucleotide
  Description of Combined DNA/RNA Molecule: Synthetic oligonucleotide
uuuuugcaacaaagcucugtt

SEQ ID NO: 1436 - DNA, 21 bp, Artificial Sequence
  Description of Artificial Sequence: Synthetic oligonucleotide
  Description of Combined DNA/RNA Molecule: Synthetic oligonucleotide
uuggaacccccaacauuuutt

SEQ ID NO: 1437 - DNA, 21 bp, Artificial Sequence
  Description of Artificial Sequence: Synthetic oligonucleotide
  Description of Combined DNA/RNA Molecule: Synthetic oligonucleotide
aaccacaauccgguuugcutt

SEQ ID NO: 1438 - DNA, 21 bp, Artificial Sequence
  Description of Artificial Sequence: Synthetic oligonucleotide
  Description of Combined DNA/RNA Molecule: Synthetic oligonucleotide
uccauucucuucacucgaatt

SEQ ID NO: 1439 - DNA, 21 bp, Artificial Sequence
  Description of Artificial Sequence: Synthetic oligonucleotide
  Description of Combined DNA/RNA Molecule: Synthetic oligonucleotide
uuugccuccaaagccuccutt

SEQ ID NO: 1440 - DNA, 21 bp, Artificial Sequence
  Description of Artificial Sequence: Synthetic oligonucleotide
  Description of Combined DNA/RNA Molecule: Synthetic oligonucleotide
uagugcuccgggucuccuutt

SEQ ID NO: 1441 - DNA, 21 bp, Artificial Sequence
  Description of Artificial Sequence: Synthetic oligonucleotide
  Description of Combined DNA/RNA Molecule: Synthetic oligonucleotide
uacugccguggacaccacatt

SEQ ID NO: 1442 - DNA, 21 bp, Artificial Sequence
  Description of Artificial Sequence: Synthetic oligonucleotide
  Description of Combined DNA/RNA Molecule: Synthetic oligonucleotide
uuauaugcagccagggccatt

SEQ ID NO: 1443 - DNA, 21 bp, Artificial Sequence
  Description of Artificial Sequence: Synthetic oligonucleotide
  Description of Combined DNA/RNA Molecule: Synthetic oligonucleotide
ugguccagcaugcaucgcatt

SEQ ID NO: 1444 - DNA, 21 bp, Artificial Sequence
  Description of Artificial Sequence: Synthetic oligonucleotide
  Description of Combined DNA/RNA Molecule: Synthetic oligonucleotide
ucagcauguccucaucacgtt

SEQ ID NO: 1445 - DNA, 21 bp, Artificial Sequence
  Description of Artificial Sequence: Synthetic oligonucleotide
  Description of Combined DNA/RNA Molecule: Synthetic oligonucleotide
ugaugucugccaccaguuatt

SEQ ID NO: 1446 - DNA, 21 bp, Artificial Sequence
  Description of Artificial Sequence: Synthetic oligonucleotide
  Description of Combined DNA/RNA Molecule: Synthetic oligonucleotide
uuaucuggccaggaagggatt

SEQ ID NO: 1447 - DNA, 21 bp, Artificial Sequence
  Description of Artificial Sequence: Synthetic oligonucleotide
  Description of Combined DNA/RNA Molecule: Synthetic oligonucleotide
ucaugaagccaaccuuguatt

SEQ ID NO: 1448 - DNA, 21 bp, Artificial Sequence
  Description of Artificial Sequence: Synthetic oligonucleotide
  Description of Combined DNA/RNA Molecule: Synthetic oligonucleotide
uccacaacugucccagucutt

SEQ ID NO: 1449 - DNA, 21 bp, Artificial Sequence
  Description of Artificial Sequence: Synthetic oligonucleotide
  Description of Combined DNA/RNA Molecule: Synthetic oligonucleotide
agugguccaccucaagagctt

SEQ ID NO: 1450 - DNA, 21 bp, Artificial Sequence
  Description of Artificial Sequence: Synthetic oligonucleotide
  Description of Combined DNA/RNA Molecule: Synthetic oligonucleotide
uuccccacauugcugaagutt

SEQ ID NO: 1451 - DNA, 21 bp, Artificial Sequence
  Description of Artificial Sequence: Synthetic oligonucleotide
  Description of Combined DNA/RNA Molecule: Synthetic oligonucleotide
agagagauccuggguguuctt

SEQ ID NO: 1452 - DNA, 21 bp, Artificial Sequence
  Description of Artificial Sequence: Synthetic oligonucleotide
  Description of Combined DNA/RNA Molecule: Synthetic oligonucleotide
uucguuccauaauacucugtt

SEQ ID NO: 1453 - DNA, 21 bp, Artificial Sequence
  Description of Artificial Sequence: Synthetic oligonucleotide
  Description of Combined DNA/RNA Molecule: Synthetic oligonucleotide
uuccauguggaauaaagcutt

SEQ ID NO: 1454 - DNA, 21 bp, Artificial Sequence
  Description of Artificial Sequence: Synthetic oligonucleotide
  Description of Combined DNA/RNA Molecule: Synthetic oligonucleotide
uggauuuuauagcaguugutt

SEQ ID NO: 1455 - DNA, 21 bp, Artificial Sequence
  Description of Artificial Sequence: Synthetic oligonucleotide
  Description of Combined DNA/RNA Molecule: Synthetic oligonucleotide
uugccccggauguuggggatt

SEQ ID NO: 1456 - DNA, 21 bp, Artificial Sequence
  Description of Artificial Sequence: Synthetic oligonucleotide
  Description of Combined DNA/RNA Molecule: Synthetic oligonucleotide
uguuuugcacagccgcccatt

SEQ ID NO: 1457 - DNA, 21 bp, Artificial Sequence
  Description of Artificial Sequence: Synthetic oligonucleotide
  Description of Combined DNA/RNA Molecule: Synthetic oligonucleotide
uuuggagggaagguugguutt

SEQ ID NO: 1458 - DNA, 21 bp, Artificial Sequence
  Description of Artificial Sequence: Synthetic oligonucleotide
  Description of Combined DNA/RNA Molecule: Synthetic oligonucleotide
aagccccggaaggccgugutt

SEQ ID NO: 1459 - DNA, 21 bp, Artificial Sequence
  Description of Artificial Sequence: Synthetic oligonucleotide
  Description of Combined DNA/RNA Molecule: Synthetic oligonucleotide
auccccuggggccccccaatt

SEQ ID NO: 1460 - DNA, 21 bp, Artificial Sequence
  Description of Artificial Sequence: Synthetic oligonucleotide
  Description of Combined DNA/RNA Molecule: Synthetic oligonucleotide
agcacucggcaaugagcautt

SEQ ID NO: 1461 - DNA, 21 bp, Artificial Sequence
  Description of Artificial Sequence: Synthetic oligonucleotide
  Description of Combined DNA/RNA Molecule: Synthetic oligonucleotide
uugcaacuucacucauccatt

SEQ ID NO: 1462 - DNA, 21 bp, Artificial Sequence
  Description of Artificial Sequence: Synthetic oligonucleotide
  Description of Combined DNA/RNA Molecule: Synthetic oligonucleotide
aggcaucccacaggucacutt

SEQ ID NO: 1463 - DNA, 21 bp, Artificial Sequence
  Description of Artificial Sequence: Synthetic oligonucleotide
  Description of Combined DNA/RNA Molecule: Synthetic oligonucleotide
uccgcaccuccucugcaggtt

SEQ ID NO: 1464 - DNA, 21 bp, Artificial Sequence
  Description of Artificial Sequence: Synthetic oligonucleotide
  Description of Combined DNA/RNA Molecule: Synthetic oligonucleotide
cuuuguacagguuuuuucutt

SEQ ID NO: 1465 - DNA, 21 bp, Artificial Sequence
  Description of Artificial Sequence: Synthetic oligonucleotide
  Description of Combined DNA/RNA Molecule: Synthetic oligonucleotide
uugucagguccccuucuuutt

SEQ ID NO: 1466 - DNA, 21 bp, Artificial Sequence
  Description of Artificial Sequence: Synthetic oligonucleotide
  Description of Combined DNA/RNA Molecule: Synthetic oligonucleotide
aagcuucugguugaagugutt

SEQ ID NO: 1467 - DNA, 21 bp, Artificial Sequence
  Description of Artificial Sequence: Synthetic oligonucleotide
  Description of Combined DNA/RNA Molecule: Synthetic oligonucleotide
ugcaaggugaaacccucaatt

SEQ ID NO: 1468 - DNA, 21 bp, Artificial Sequence
  Description of Artificial Sequence: Synthetic oligonucleotide
  Description of Combined DNA/RNA Molecule: Synthetic oligonucleotide
ucauucuucccagcaucugtt

SEQ ID NO: 1469 - DNA, 21 bp, Artificial Sequence
  Description of Artificial Sequence: Synthetic oligonucleotide
  Description of Combined DNA/RNA Molecule: Synthetic oligonucleotide
acugagagcuugcuaggcatt

SEQ ID NO: 1470 - DNA, 21 bp, Artificial Sequence
  Description of Artificial Sequence: Synthetic oligonucleotide
  Description of Combined DNA/RNA Molecule: Synthetic oligonucleotide
uacucuuccgagcaugauatt

SEQ ID NO: 1471 - DNA, 21 bp, Artificial Sequence
  Description of Artificial Sequence: Synthetic oligonucleotide
  Description of Combined DNA/RNA Molecule: Synthetic oligonucleotide
ugaacuugucaaccucacutt

SEQ ID NO: 1472 - DNA, 21 bp, Artificial Sequence
  Description of Artificial Sequence: Synthetic oligonucleotide
  Description of Combined DNA/RNA Molecule: Synthetic oligonucleotide
uccaacaauucuccuuguutt

SEQ ID NO: 1473 - DNA, 21 bp, Artificial Sequence
  Description of Artificial Sequence: Synthetic oligonucleotide
  Description of Combined DNA/RNA Molecule: Synthetic oligonucleotide
ugcacaauccucucuuuuutt

SEQ ID NO: 1474 - DNA, 21 bp, Artificial Sequence
  Description of Artificial Sequence: Synthetic oligonucleotide
  Description of Combined DNA/RNA Molecule: Synthetic oligonucleotide
aaacuuggugggaauuaugtt

SEQ ID NO: 1475 - DNA, 21 bp, Artificial Sequence
  Description of Artificial Sequence: Synthetic oligonucleotide
  Description of Combined DNA/RNA Molecule: Synthetic oligonucleotide
uuguaaagcuuauuccaaatt

SEQ ID NO: 1476 - DNA, 21 bp, Artificial Sequence
  Description of Artificial Sequence: Synthetic oligonucleotide
  Description of Combined DNA/RNA Molecule: Synthetic oligonucleotide
uugauucagaaaaggaacutt

SEQ ID NO: 1477 - DNA, 21 bp, Artificial Sequence
  Description of Artificial Sequence: Synthetic oligonucleotide
  Description of Combined DNA/RNA Molecule: Synthetic oligonucleotide
ugaaguagggcuccugccutt

SEQ ID NO: 1478 - DNA, 21 bp, Artificial Sequence
  Description of Artificial Sequence: Synthetic oligonucleotide
  Description of Combined DNA/RNA Molecule: Synthetic oligonucleotide
agccaucuguguacacaugtt

SEQ ID NO: 1479 - DNA, 21 bp, Artificial Sequence
  Description of Artificial Sequence: Synthetic oligonucleotide
  Description of Combined DNA/RNA Molecule: Synthetic oligonucleotide
ugugggucagcagcacagatt

SEQ ID NO: 1480 - DNA, 21 bp, Artificial Sequence
  Description of Artificial Sequence: Synthetic oligonucleotide
  Description of Combined DNA/RNA Molecule: Synthetic oligonucleotide
ugguaugaaggccuuggcctt

SEQ ID NO: 1481 - DNA, 21 bp, Artificial Sequence
  Description of Artificial Sequence: Synthetic oligonucleotide
  Description of Combined DNA/RNA Molecule: Synthetic oligonucleotide
uggccaccuggaccauuuutt

SEQ ID NO: 1482 - DNA, 21 bp, Artificial Sequence
  Description of Artificial Sequence: Synthetic oligonucleotide
  Description of Combined DNA/RNA Molecule: Synthetic oligonucleotide
uuuucagagcucuacuggctt

SEQ ID NO: 1483 - DNA, 21 bp, Artificial Sequence
  Description of Artificial Sequence: Synthetic oligonucleotide
  Description of Combined DNA/RNA Molecule: Synthetic oligonucleotide
aaucuuagagguggggauutt

SEQ ID NO: 1484 - DNA, 21 bp, Artificial Sequence
  Description of Artificial Sequence: Synthetic oligonucleotide
  Description of Combined DNA/RNA Molecule: Synthetic oligonucleotide
ugcuugucucgcugauauatt

SEQ ID NO: 1485 - DNA, 21 bp, Artificial Sequence
  Description of Artificial Sequence: Synthetic oligonucleotide
  Description of Combined DNA/RNA Molecule: Synthetic oligonucleotide
ugggcacaguguuagugcutt

SEQ ID NO: 1486 - DNA, 21 bp, Artificial Sequence
  Description of Artificial Sequence: Synthetic oligonucleotide
  Description of Combined DNA/RNA Molecule: Synthetic oligonucleotide
agccgugggagagguguugtt

SEQ ID NO: 1487 - DNA, 21 bp, Artificial Sequence
  Description of Artificial Sequence: Synthetic oligonucleotide
  Description of Combined DNA/RNA Molecule: Synthetic oligonucleotide
uucagcgcugacagaggcatt

SEQ ID NO: 1488 - DNA, 21 bp, Artificial Sequence
  Description of Artificial Sequence: Synthetic oligonucleotide
  Description of Combined DNA/RNA Molecule: Synthetic oligonucleotide
acggccuguccauugaggutt

SEQ ID NO: 1489 - DNA, 21 bp, Artificial Sequence
  Description of Artificial Sequence: Synthetic oligonucleotide
  Description of Combined DNA/RNA Molecule: Synthetic oligonucleotide
ucugacaagccgcauagactt

SEQ ID NO: 1490 - DNA, 21 bp, Artificial Sequence
  Description of Artificial Sequence: Synthetic oligonucleotide
  Description of Combined DNA/RNA Molecule: Synthetic oligonucleotide
agccuuuucaagauggucutt

SEQ ID NO: 1491 - DNA, 21 bp, Artificial Sequence
  Description of Artificial Sequence: Synthetic oligonucleotide
  Description of Combined DNA/RNA Molecule: Synthetic oligonucleotide
uucuucuuguaggguuccatt

SEQ ID NO: 1492 - DNA, 21 bp, Artificial Sequence
  Description of Artificial Sequence: Synthetic oligonucleotide
  Description of Combined DNA/RNA Molecule: Synthetic oligonucleotide
aggagccacugggauucuutt

SEQ ID NO: 1493 - DNA, 21 bp, Artificial Sequence
  Description of Artificial Sequence: Synthetic oligonucleotide
  Description of Combined DNA/RNA Molecule: Synthetic oligonucleotide
uugugacccagucuucccatt

SEQ ID NO: 1494 - DNA, 21 bp, Artificial Sequence
  Description of Artificial Sequence: Synthetic oligonucleotide
  Description of Combined DNA/RNA Molecule: Synthetic oligonucleotide
uguccauguaggcagcugutt

SEQ ID NO: 1495 - DNA, 21 bp, Artificial Sequence
  Description of Artificial Sequence: Synthetic oligonucleotide
  Description of Combined DNA/RNA Molecule: Synthetic oligonucleotide
uggcagacaagcucacugutt

SEQ ID NO: 1496 - DNA, 21 bp, Artificial Sequence
  Description of Artificial Sequence: Synthetic oligonucleotide
  Description of Combined DNA/RNA Molecule: Synthetic oligonucleotide
uuguucuauaaaacccagutt

SEQ ID NO: 1497 - DNA, 21 bp, Artificial Sequence
  Description of Artificial Sequence: Synthetic oligonucleotide
  Description of Combined DNA/RNA Molecule: Synthetic oligonucleotide
ucuguagcccagauugggutt

SEQ ID NO: 1498 - DNA, 21 bp, Artificial Sequence
  Description of Artificial Sequence: Synthetic oligonucleotide
  Description of Combined DNA/RNA Molecule: Synthetic oligonucleotide
ugaguuagucucaaagcugtt

SEQ ID NO: 1499 - DNA, 21 bp, Artificial Sequence
  Description of Artificial Sequence: Synthetic oligonucleotide
  Description of Combined DNA/RNA Molecule: Synthetic oligonucleotide
aguaguggaagggguuccctt

SEQ ID NO: 1500 - DNA, 21 bp, Artificial Sequence
  Description of Artificial Sequence: Synthetic oligonucleotide
  Description of Combined DNA/RNA Molecule: Synthetic oligonucleotide
agccaccccauagcugaagtt

SEQ ID NO: 1501 - DNA, 21 bp, Artificial Sequence
  Description of Artificial Sequence: Synthetic oligonucleotide
  Description of Combined DNA/RNA Molecule: Synthetic oligonucleotide
auuucuacuucagagcaagtt

SEQ ID NO: 1502 - DNA, 21 bp, Artificial Sequence
  Description of Artificial Sequence: Synthetic oligonucleotide
  Description of Combined DNA/RNA Molecule: Synthetic oligonucleotide
ucuguuaggcagucgauuutt

SEQ ID NO: 1503 - DNA, 21 bp, Artificial Sequence
  Description of Artificial Sequence: Synthetic oligonucleotide
  Description of Combined DNA/RNA Molecule: Synthetic oligonucleotide
uggagguucuuaugaucuctt

SEQ ID NO: 1504 - DNA, 21 bp, Artificial Sequence
  Description of Artificial Sequence: Synthetic oligonucleotide
  Description of Combined DNA/RNA Molecule: Synthetic oligonucleotide
uccaugacaauaucugugctt

SEQ ID NO: 1505 - DNA, 21 bp, Artificial Sequence
  Description of Artificial Sequence: Synthetic oligonucleotide
  Description of Combined DNA/RNA Molecule: Synthetic oligonucleotide
agacuggagccaacauccatt

SEQ ID NO: 1506 - DNA, 21 bp, Artificial Sequence
  Description of Artificial Sequence: Synthetic oligonucleotide
  Description of Combined DNA/RNA Molecule: Synthetic oligonucleotide
auaucaauggcaggguuuatt

SEQ ID NO: 1507 - DNA, 21 bp, Artificial Sequence
  Description of Artificial Sequence: Synthetic oligonucleotide
  Description of Combined DNA/RNA Molecule: Synthetic oligonucleotide
uccccuuccaccuguccaatt

SEQ ID NO: 1508 - DNA, 21 bp, Artificial Sequence
  Description of Artificial Sequence: Synthetic oligonucleotide
  Description of Combined DNA/RNA Molecule: Synthetic oligonucleotide
aggcccuggacaaaugccctt

SEQ ID NO: 1509 - DNA, 21 bp, Artificial Sequence
  Description of Artificial Sequence: Synthetic oligonucleotide
  Description of Combined DNA/RNA Molecule: Synthetic oligonucleotide
ucuagggugaagaggccaatt

SEQ ID NO: 1510 - DNA, 21 bp, Artificial Sequence
  Description of Artificial Sequence: Synthetic oligonucleotide
  Description of Combined DNA/RNA Molecule: Synthetic oligonucleotide
ugaauaguguagcuccucutt

SEQ ID NO: 1511 - DNA, 21 bp, Artificial Sequence
  Description of Artificial Sequence: Synthetic oligonucleotide
  Description of Combined DNA/RNA Molecule: Synthetic oligonucleotide
uugcaggcuccccucggggtt

SEQ ID NO: 1512 - DNA, 21 bp, Artificial Sequence
  Description of Artificial Sequence: Synthetic oligonucleotide
  Description of Combined DNA/RNA Molecule: Synthetic oligonucleotide
ugcuagggccacgggugugtt

SEQ ID NO: 1513 - DNA, 21 bp, Artificial Sequence
  Description of Artificial Sequence: Synthetic oligonucleotide
  Description of Combined DNA/RNA Molecule: Synthetic oligonucleotide
augccgggaucuuguaggutt

SEQ ID NO: 1514 - DNA, 21 bp, Artificial Sequence
  Description of Artificial Sequence: Synthetic oligonucleotide
  Description of Combined DNA/RNA Molecule: Synthetic oligonucleotide
uaauggggaugcugccaaatt

SEQ ID NO: 1515 - DNA, 21 bp, Artificial Sequence
  Description of Artificial Sequence: Synthetic oligonucleotide
  Description of Combined DNA/RNA Molecule: Synthetic oligonucleotide
ugggcagucgcggagcaggtt

SEQ ID NO: 1516 - DNA, 21 bp, Artificial Sequence
  Description of Artificial Sequence: Synthetic oligonucleotide
  Description of Combined DNA/RNA Molecule: Synthetic oligonucleotide
auagauggccuucuuguugtt

SEQ ID NO: 1517 - DNA, 21 bp, Artificial Sequence
  Description of Artificial Sequence: Synthetic oligonucleotide
  Description of Combined DNA/RNA Molecule: Synthetic oligonucleotide
uaacagccuucgaugcauatt

SEQ ID NO: 1518 - DNA, 21 bp, Artificial Sequence
  Description of Artificial Sequence: Synthetic oligonucleotide
  Description of Combined DNA/RNA Molecule: Synthetic oligonucleotide
uaagaggggcggcucuccatt

SEQ ID NO: 1519 - DNA, 21 bp, Artificial Sequence
  Description of Artificial Sequence: Synthetic oligonucleotide
  Description of Combined DNA/RNA Molecule: Synthetic oligonucleotide
aagauagaagcagccaggatt

SEQ ID NO: 1520 - DNA, 21 bp, Artificial Sequence
  Description of Artificial Sequence: Synthetic oligonucleotide
  Description of Combined DNA/RNA Molecule: Synthetic oligonucleotide
uaucuuugauggcaaagaatt

SEQ ID NO: 1521 - DNA, 21 bp, Artificial Sequence
  Description of Artificial Sequence: Synthetic oligonucleotide
  Description of Combined DNA/RNA Molecule: Synthetic oligonucleotide
ucucgagcugcacggauggtt

SEQ ID NO: 1522 - DNA, 21 bp, Artificial Sequence
  Description of Artificial Sequence: Synthetic oligonucleotide
  Description of Combined DNA/RNA Molecule: Synthetic oligonucleotide
auuaccugugugcugagcutt

SEQ ID NO: 1523 - DNA, 21 bp, Artificial Sequence
  Description of Artificial Sequence: Synthetic oligonucleotide
  Description of Combined DNA/RNA Molecule: Synthetic oligonucleotide
agaguuccuucacguuauutt

SEQ ID NO: 1524 - DNA, 21 bp, Artificial Sequence
  Description of Artificial Sequence: Synthetic oligonucleotide
  Description of Combined DNA/RNA Molecule: Synthetic oligonucleotide
uagggcugucuagccggaatt

SEQ ID NO: 1525 - DNA, 21 bp, Artificial Sequence
  Description of Artificial Sequence: Synthetic oligonucleotide
  Description of Combined DNA/RNA Molecule: Synthetic oligonucleotide
uaucuucuccgggguggcatt

SEQ ID NO: 1526 - DNA, 21 bp, Artificial Sequence
  Description of Artificial Sequence: Synthetic oligonucleotide
  Description of Combined DNA/RNA Molecule: Synthetic oligonucleotide
ucacgcaggcauugcggautt

SEQ ID NO: 1527 - DNA, 21 bp, Artificial Sequence
  Description of Artificial Sequence: Synthetic oligonucleotide
  Description of Combined DNA/RNA Molecule: Synthetic oligonucleotide
acaggguggugaacuuguctt

SEQ ID NO: 1528 - DNA, 21 bp, Artificial Sequence
  Description of Artificial Sequence: Synthetic oligonucleotide
  Description of Combined DNA/RNA Molecule: Synthetic oligonucleotide
uggacaccagugacacacatt

SEQ ID NO: 1529 - DNA, 21 bp, Artificial Sequence
  Description of Artificial Sequence: Synthetic oligonucleotide
  Description of Combined DNA/RNA Molecule: Synthetic oligonucleotide
ucaggguuugcaguuuucutt

SEQ ID NO: 1530 - DNA, 21 bp, Artificial Sequence
  Description of Artificial Sequence: Synthetic oligonucleotide
  Description of Combined DNA/RNA Molecule: Synthetic oligonucleotide
uuagacccucacagaccagtt

SEQ ID NO: 1531 - DNA, 21 bp, Artificial Sequence
  Description of Artificial Sequence: Synthetic oligonucleotide
  Description of Combined DNA/RNA Molecule: Synthetic oligonucleotide
ugcugaggacucucucuuutt

SEQ ID NO: 1532 - DNA, 21 bp, Artificial Sequence
  Description of Artificial Sequence: Synthetic oligonucleotide
  Description of Combined DNA/RNA Molecule: Synthetic oligonucleotide
ugcagcacaagaagacucutt

SEQ ID NO: 1533 - DNA, 21 bp, Artificial Sequence
  Description of Artificial Sequence: Synthetic oligonucleotide
  Description of Combined DNA/RNA Molecule: Synthetic oligonucleotide
uccauggaagcccaaaggctt

SEQ ID NO: 1534 - DNA, 21 bp, Artificial Sequence
  Description of Artificial Sequence: Synthetic oligonucleotide
  Description of Combined DNA/RNA Molecule: Synthetic oligonucleotide
uuaauagauccauguucugtt

SEQ ID NO: 1535 - DNA, 21 bp, Artificial Sequence
  Description of Artificial Sequence: Synthetic oligonucleotide
  Description of Combined DNA/RNA Molecule: Synthetic oligonucleotide
ugucauucugugacuuuaatt

SEQ ID NO: 1536 - DNA, 21 bp, Artificial Sequence
  Description of Artificial Sequence: Synthetic oligonucleotide
  Description of Combined DNA/RNA Molecule: Synthetic oligonucleotide
uuugacaaaucacaggucutt

SEQ ID NO: 1537 - DNA, 21 bp, Artificial Sequence
  Description of Artificial Sequence: Synthetic oligonucleotide
  Description of Combined DNA/RNA Molecule: Synthetic oligonucleotide
ugucuuccaaaucccaucutt

SEQ ID NO: 1538 - DNA, 21 bp, Artificial Sequence
  Description of Artificial Sequence: Synthetic oligonucleotide
  Description of Combined DNA/RNA Molecule: Synthetic oligonucleotide
ucuuccauugcauucacuutt

SEQ ID NO: 1539 - DNA, 21 bp, Artificial Sequence
  Description of Artificial Sequence: Synthetic oligonucleotide
  Description of Combined DNA/RNA Molecule: Synthetic oligonucleotide
uauuuuugaucaaaaucuutt

SEQ ID NO: 1540 - DNA, 21 bp, Artificial Sequence
  Description of Artificial Sequence: Synthetic oligonucleotide
  Description of Combined DNA/RNA Molecule: Synthetic oligonucleotide
auuguguuuacaaauuacatt

SEQ ID NO: 1541 - DNA, 21 bp, Artificial Sequence
  Description of Artificial Sequence: Synthetic oligonucleotide
  Description of Combined DNA/RNA Molecule: Synthetic oligonucleotide
aguuuugaauuugcuuauctt

SEQ ID NO: 1542 - DNA, 21 bp, Artificial Sequence
  Description of Artificial Sequence: Synthetic oligonucleotide
  Description of Combined DNA/RNA Molecule: Synthetic oligonucleotide
accauuuaggcauaacagutt

SEQ ID NO: 1543 - DNA, 21 bp, Artificial Sequence
  Description of Artificial Sequence: Synthetic oligonucleotide
  Description of Combined DNA/RNA Molecule: Synthetic oligonucleotide
uauccuaauugcauauucatt

SEQ ID NO: 1544 - DNA, 21 bp, Artificial Sequence
  Description of Artificial Sequence: Synthetic oligonucleotide
  Description of Combined DNA/RNA Molecule: Synthetic oligonucleotide
aaaacagacagaaaaugautt

SEQ ID NO: 1545 - DNA, 21 bp, Artificial Sequence
  Description of Artificial Sequence: Synthetic oligonucleotide
  Description of Combined DNA/RNA Molecule: Synthetic oligonucleotide
auuccagauacaugauuaatt

SEQ ID NO: 1546 - DNA, 21 bp, Artificial Sequence
  Description of Artificial Sequence: Synthetic oligonucleotide
  Description of Combined DNA/RNA Molecule: Synthetic oligonucleotide
aacccuucccgacccuauutt

SEQ ID NO: 1547 - DNA, 21 bp, Artificial Sequence
  Description of Artificial Sequence: Synthetic oligonucleotide
  Description of Combined DNA/RNA Molecule: Synthetic oligonucleotide
aaguggggaauagcacaaatt

SEQ ID NO: 1548 - DNA, 21 bp, Artificial Sequence
  Description of Artificial Sequence: Synthetic oligonucleotide
  Description of Combined DNA/RNA Molecule: Synthetic oligonucleotide
uauacaggcuguccaguaatt

SEQ ID NO: 1549 - DNA, 21 bp, Artificial Sequence
  Description of Artificial Sequence: Synthetic oligonucleotide
  Description of Combined DNA/RNA Molecule: Synthetic oligonucleotide
accaucagaacuugagguutt

SEQ ID NO: 1550 - DNA, 21 bp, Artificial Sequence
  Description of Artificial Sequence: Synthetic oligonucleotide
  Description of Combined DNA/RNA Molecule: Synthetic oligonucleotide
ucucuucaaaggacagacatt

SEQ ID NO: 1551 - DNA, 21 bp, Artificial Sequence
  Description of Artificial Sequence: Synthetic oligonucleotide
  Description of Combined DNA/RNA Molecule: Synthetic oligonucleotide
agagguuugugggaauccutt

SEQ ID NO: 1552 - DNA, 21 bp, Artificial Sequence
  Description of Artificial Sequence: Synthetic oligonucleotide
  Description of Combined DNA/RNA Molecule: Synthetic oligonucleotide
acuucgguuuaagcuucuatt

SEQ ID NO: 1553 - DNA, 21 bp, Artificial Sequence
  Description of Artificial Sequence: Synthetic oligonucleotide
  Description of Combined DNA/RNA Molecule: Synthetic oligonucleotide
acacgauuuaaaguaacuutt

SEQ ID NO: 1554 - DNA, 21 bp, Artificial Sequence
  Description of Artificial Sequence: Synthetic oligonucleotide
  Description of Combined DNA/RNA Molecule: Synthetic oligonucleotide
aggcuuucacaggaaggcatt

SEQ ID NO: 1555 - DNA, 21 bp, Artificial Sequence
  Description of Artificial Sequence: Synthetic oligonucleotide
  Description of Combined DNA/RNA Molecule: Synthetic oligonucleotide
ucauugguuugaaggccagtt

SEQ ID NO: 1556 - DNA, 21 bp, Artificial Sequence
  Description of Artificial Sequence: Synthetic oligonucleotide
  Description of Combined DNA/RNA Molecule: Synthetic oligonucleotide
aagguuaugcuuugcuguutt

SEQ ID NO: 1557 - DNA, 21 bp, Artificial Sequence
  Description of Artificial Sequence: Synthetic oligonucleotide
  Description of Combined DNA/RNA Molecule: Synthetic oligonucleotide
aauuugaguauagauucaatt

SEQ ID NO: 1558 - DNA, 21 bp, Artificial Sequence
  Description of Artificial Sequence: Synthetic oligonucleotide
  Description of Combined DNA/RNA Molecule: Synthetic oligonucleotide
ucacugccucauugcaaaatt

SEQ ID NO: 1559 - DNA, 21 bp, Artificial Sequence
  Description of Artificial Sequence: Synthetic oligonucleotide
  Description of Combined DNA/RNA Molecule: Synthetic oligonucleotide
aggauuuaaccuuaccccatt

SEQ ID NO: 1560 - DNA, 21 bp, Artificial Sequence
  Description of Artificial Sequence: Synthetic oligonucleotide
  Description of Combined DNA/RNA Molecule: Synthetic oligonucleotide
ugauucaaagaugguuagatt

SEQ ID NO: 1561 - DNA, 21 bp, Artificial Sequence
  Description of Artificial Sequence: Synthetic oligonucleotide
  Description of Combined DNA/RNA Molecule: Synthetic oligonucleotide
cuuuauucuuuccaaugautt

SEQ ID NO: 1562 - DNA, 21 bp, Artificial Sequence
  Description of Artificial Sequence: Synthetic oligonucleotide
  Description of Combined DNA/RNA Molecule: Synthetic oligonucleotide
accuugaauuuguuucauutt

SEQ ID NO: 1563 - DNA, 21 bp, Artificial Sequence
  Description of Artificial Sequence: Synthetic oligonucleotide
  Description of Combined DNA/RNA Molecule: Synthetic oligonucleotide
aaucagauccaauuaaccutt

SEQ ID NO: 1564 - DNA, 21 bp, Artificial Sequence
  Description of Artificial Sequence: Synthetic oligonucleotide
  Description of Combined DNA/RNA Molecule: Synthetic oligonucleotide
cuuuaugcagcuucacaaatt

SEQ ID NO: 1565 - DNA, 21 bp, Artificial Sequence
  Description of Artificial Sequence: Synthetic oligonucleotide
  Description of Combined DNA/RNA Molecule: Synthetic oligonucleotide
auuauagaguaaucuugcutt

SEQ ID NO: 1566 - DNA, 21 bp, Artificial Sequence
  Description of Artificial Sequence: Synthetic oligonucleotide
  Description of Combined DNA/RNA Molecule: Synthetic oligonucleotide
aguugguuggauuuuuguatt

SEQ ID NO: 1567 - DNA, 21 bp, Artificial Sequence
  Description of Artificial Sequence: Synthetic oligonucleotide
  Description of Combined DNA/RNA Molecule: Synthetic oligonucleotide
acgugcucaauaauugagutt

SEQ ID NO: 1568 - DNA, 21 bp, Artificial Sequence
  Description of Artificial Sequence: Synthetic oligonucleotide
  Description of Combined DNA/RNA Molecule: Synthetic oligonucleotide
agaaaucuagaacauuguatt

SEQ ID NO: 1569 - DNA, 21 bp, Artificial Sequence
  Description of Artificial Sequence: Synthetic oligonucleotide
  Description of Combined DNA/RNA Molecule: Synthetic oligonucleotide
uaaagaggaagggaaagaatt

SEQ ID NO: 1570 - DNA, 21 bp, Artificial Sequence
  Description of Artificial Sequence: Synthetic oligonucleotide
  Description of Combined DNA/RNA Molecule: Synthetic oligonucleotide
uaauacaaauauucucuuctt

SEQ ID NO: 1571 - DNA, 21 bp, Artificial Sequence
  Description of Artificial Sequence: Synthetic oligonucleotide
  Description of Combined DNA/RNA Molecule: Synthetic oligonucleotide
acucaaagaguauuuggaatt

SEQ ID NO: 1572 - DNA, 21 bp, Artificial Sequence
  Description of Artificial Sequence: Synthetic oligonucleotide
  Description of Combined DNA/RNA Molecule: Synthetic oligonucleotide
auaaucuuuuuuguaaauatt

SEQ ID NO: 1573 - DNA, 21 bp, Artificial Sequence
  Description of Artificial Sequence: Synthetic oligonucleotide
  Description of Combined DNA/RNA Molecule: Synthetic oligonucleotide
aauguaaagauuaaacauatt

SEQ ID NO: 1574 - DNA, 21 bp, Artificial Sequence
  Description of Artificial Sequence: Synthetic oligonucleotide
  Description of Combined DNA/RNA Molecule: Synthetic oligonucleotide
aaauuacuuuggcuucaaatt

SEQ ID NO: 1575 - DNA, 21 bp, Artificial Sequence
  Description of Artificial Sequence: Synthetic oligonucleotide
  Description of Combined DNA/RNA Molecule: Synthetic oligonucleotide
ucaucauuucuagguggaatt

SEQ ID NO: 1576 - DNA, 21 bp, Artificial Sequence
  Description of Artificial Sequence: Synthetic oligonucleotide
  Description of Combined DNA/RNA Molecule: Synthetic oligonucleotide
uaccaugccaggacugauatt

SEQ ID NO: 1577 - DNA, 21 bp, Artificial Sequence
  Description of Artificial Sequence: Synthetic oligonucleotide
  Description of Combined DNA/RNA Molecule: Synthetic oligonucleotide
ugauuauaggggugagccatt

SEQ ID NO: 1578 - DNA, 21 bp, Artificial Sequence
  Description of Artificial Sequence: Synthetic oligonucleotide
  Description of Combined DNA/RNA Molecule: Synthetic oligonucleotide
ucucccaaagugcugggautt

SEQ ID NO: 1579 - DNA, 21 bp, Artificial Sequence
  Description of Artificial Sequence: Synthetic oligonucleotide
  Description of Combined DNA/RNA Molecule: Synthetic oligonucleotide
agcaauucuccugccuuagtt

SEQ ID NO: 1580 - DNA, 21 bp, Artificial Sequence
  Description of Artificial Sequence: Synthetic oligonucleotide
  Description of Combined DNA/RNA Molecule: Synthetic oligonucleotide
aaacugcugggcucaagcatt

SEQ ID NO: 1581 - DNA, 21 bp, Artificial Sequence
  Description of Artificial Sequence: Synthetic oligonucleotide
  Description of Combined DNA/RNA Molecule: Synthetic oligonucleotide
uugcccaggcuggucucaatt

SEQ ID NO: 1582 - DNA, 21 bp, Artificial Sequence
  Description of Artificial Sequence: Synthetic oligonucleotide
  Description of Combined DNA/RNA Molecule: Synthetic oligonucleotide
agacaggagcucucuaugutt

SEQ ID NO: 1583 - DNA, 21 bp, Artificial Sequence
  Description of Artificial Sequence: Synthetic oligonucleotide
  Description of Combined DNA/RNA Molecule: Synthetic oligonucleotide
aaaaaauuuuuuuuaaagatt

SEQ ID NO: 1584 - DNA, 21 bp, Artificial Sequence
  Description of Artificial Sequence: Synthetic oligonucleotide
  Description of Combined DNA/RNA Molecule: Synthetic oligonucleotide
aucaagaccaacuaauuaatt

SEQ ID NO: 1585 - DNA, 21 bp, Artificial Sequence
  Description of Artificial Sequence: Synthetic oligonucleotide
  Description of Combined DNA/RNA Molecule: Synthetic oligonucleotide
ugacuacaggcaugcacuatt

SEQ ID NO: 1586 - DNA, 21 bp, Artificial Sequence
  Description of Artificial Sequence: Synthetic oligonucleotide
  Description of Combined DNA/RNA Molecule: Synthetic oligonucleotide
agccuuucaaguaguugggtt

SEQ ID NO: 1587 - DNA, 21 bp, Artificial Sequence
  Description of Artificial Sequence: Synthetic oligonucleotide
  Description of Combined DNA/RNA Molecule: Synthetic oligonucleotide
aaugaucucuccaccucagtt

SEQ ID NO: 1588 - DNA, 21 bp, Artificial Sequence
  Description of Artificial Sequence: Synthetic oligonucleotide
  Description of Combined DNA/RNA Molecule: Synthetic oligonucleotide
ucaaccuccugagcucaaatt

SEQ ID NO: 1589 - DNA, 21 bp, Artificial Sequence
  Description of Artificial Sequence: Synthetic oligonucleotide
  Description of Combined DNA/RNA Molecule: Synthetic oligonucleotide
uagcucacugcagccucaatt

SEQ ID NO: 1590 - DNA, 21 bp, Artificial Sequence
  Description of Artificial Sequence: Synthetic oligonucleotide
  Description of Combined DNA/RNA Molecule: Synthetic oligonucleotide
ucagucgcucaggcaggagtt

SEQ ID NO: 1591 - DNA, 21 bp, Artificial Sequence
  Description of Artificial Sequence: Synthetic oligonucleotide
  Description of Combined DNA/RNA Molecule: Synthetic oligonucleotide
agagacaagaucuugcucatt

SEQ ID NO: 1592 - DNA, 21 bp, Artificial Sequence
  Description of Artificial Sequence: Synthetic oligonucleotide
  Description of Combined DNA/RNA Molecule: Synthetic oligonucleotide
auuucuuuuuuuuucuucatt

SEQ ID NO: 1593 - DNA, 21 bp, Artificial Sequence
  Description of Artificial Sequence: Synthetic oligonucleotide
  Description of Combined DNA/RNA Molecule: Synthetic oligonucleotide
uuugauagcagcauuuuuatt

SEQ ID NO: 1594 - DNA, 21 bp, Artificial Sequence
  Description of Artificial Sequence: Synthetic oligonucleotide
  Description of Combined DNA/RNA Molecule: Synthetic oligonucleotide
ucugguugggcuugauuuutt

SEQ ID NO: 1595 - DNA, 21 bp, Artificial Sequence
  Description of Artificial Sequence: Synthetic oligonucleotide
  Description of Combined DNA/RNA Molecule: Synthetic oligonucleotide
ucuuggcucuucuaccucutt

SEQ ID NO: 1596 - DNA, 21 bp, Artificial Sequence
  Description of Artificial Sequence: Synthetic oligonucleotide
  Description of Combined DNA/RNA Molecule: Synthetic oligonucleotide
aggaugagaacccaggcuutt

SEQ ID NO: 1597 - DNA, 21 bp, Artificial Sequence
  Description of Artificial Sequence: Synthetic oligonucleotide
  Description of Combined DNA/RNA Molecule: Synthetic oligonucleotide
acagaagagacagagcuagtt

SEQ ID NO: 1598 - DNA, 21 bp, Artificial Sequence
  Description of Artificial Sequence: Synthetic oligonucleotide
  Description of Combined DNA/RNA Molecule: Synthetic oligonucleotide
aggggaauugacaguccaatt

SEQ ID NO: 1599 - DNA, 21 bp, Artificial Sequence
  Description of Artificial Sequence: Synthetic oligonucleotide
  Description of Combined DNA/RNA Molecule: Synthetic oligonucleotide
aaaauggaucacaggaaggtt

SEQ ID NO: 1600 - DNA, 21 bp, Artificial Sequence
  Description of Artificial Sequence: Synthetic oligonucleotide
  Description of Combined DNA/RNA Molecule: Synthetic oligonucleotide
uaaagcagaagacgugagatt

SEQ ID NO: 1601 - DNA, 21 bp, Artificial Sequence
  Description of Artificial Sequence: Synthetic oligonucleotide
  Description of Combined DNA/RNA Molecule: Synthetic oligonucleotide
uuggaguuuucaggucauatt

SEQ ID NO: 1602 - DNA, 21 bp, Artificial Sequence
  Description of Artificial Sequence: Synthetic oligonucleotide
  Description of Combined DNA/RNA Molecule: Synthetic oligonucleotide
uugcagauccuuuauguaatt

SEQ ID NO: 1603 - DNA, 21 bp, Artificial Sequence
  Description of Artificial Sequence: Synthetic oligonucleotide
  Description of Combined DNA/RNA Molecule: Synthetic oligonucleotide
accaagccuuagauagcugtt

SEQ ID NO: 1604 - DNA, 21 bp, Artificial Sequence
  Description of Artificial Sequence: Synthetic oligonucleotide
  Description of Combined DNA/RNA Molecule: Synthetic oligonucleotide
uauuagacccagguaucautt

SEQ ID NO: 1605 - DNA, 21 bp, Artificial Sequence
  Description of Artificial Sequence: Synthetic oligonucleotide
  Description of Combined DNA/RNA Molecule: Synthetic oligonucleotide
aggugaucucagcagaguutt

SEQ ID NO: 1606 - DNA, 21 bp, Artificial Sequence
  Description of Artificial Sequence: Synthetic oligonucleotide
  Description of Combined DNA/RNA Molecule: Synthetic oligonucleotide
aaccgcagaaacuugaggutt

SEQ ID NO: 1607 - DNA, 21 bp, Artificial Sequence
  Description of Artificial Sequence: Synthetic oligonucleotide
  Description of Combined DNA/RNA Molecule: Synthetic oligonucleotide
uccuuguucucuuuaccaatt

SEQ ID NO: 1608 - DNA, 21 bp, Artificial Sequence
  Description of Artificial Sequence: Synthetic oligonucleotide
  Description of Combined DNA/RNA Molecule: Synthetic oligonucleotide
aaaagggauguuuguucuutt

SEQ ID NO: 1609 - DNA, 21 bp, Artificial Sequence
  Description of Artificial Sequence: Synthetic oligonucleotide
  Description of Combined DNA/RNA Molecule: Synthetic oligonucleotide
accauuuggagcaauaaaatt

SEQ ID NO: 1610 - DNA, 21 bp, Artificial Sequence
  Description of Artificial Sequence: Synthetic oligonucleotide
  Description of Combined DNA/RNA Molecule: Synthetic oligonucleotide
accauguagggauuaaauctt

SEQ ID NO: 1611 - DNA, 21 bp, Artificial Sequence
  Description of Artificial Sequence: Synthetic oligonucleotide
  Description of Combined DNA/RNA Molecule: Synthetic oligonucleotide
acauuguccacccagcacctt

SEQ ID NO: 1612 - DNA, 21 bp, Artificial Sequence
  Description of Artificial Sequence: Synthetic oligonucleotide
  Description of Combined DNA/RNA Molecule: Synthetic oligonucleotide
aaggcaugugacagugacatt

SEQ ID NO: 1613 - DNA, 21 bp, Artificial Sequence
  Description of Artificial Sequence: Synthetic oligonucleotide
  Description of Combined DNA/RNA Molecule: Synthetic oligonucleotide
uuuggauuuauacagugaatt

SEQ ID NO: 1614 - DNA, 21 bp, Artificial Sequence
  Description of Artificial Sequence: Synthetic oligonucleotide
  Description of Combined DNA/RNA Molecule: Synthetic oligonucleotide
auucucucuggcagaaggutt

SEQ ID NO: 1615 - DNA, 21 bp, Artificial Sequence
  Description of Artificial Sequence: Synthetic oligonucleotide
  Description of Combined DNA/RNA Molecule: Synthetic oligonucleotide
ucacuauccucccuccaugtt

SEQ ID NO: 1616 - DNA, 21 bp, Artificial Sequence
  Description of Artificial Sequence: Synthetic oligonucleotide
  Description of Combined DNA/RNA Molecule: Synthetic oligonucleotide
uaguccaacuauaucauuutt

SEQ ID NO: 1617 - DNA, 21 bp, Artificial Sequence
  Description of Artificial Sequence: Synthetic oligonucleotide
  Description of Combined DNA/RNA Molecule: Synthetic oligonucleotide
agugacaucaagcaccagutt

SEQ ID NO: 1618 - DNA, 21 bp, Artificial Sequence
  Description of Artificial Sequence: Synthetic oligonucleotide
  Description of Combined DNA/RNA Molecule: Synthetic oligonucleotide
ugacaguuucauuuauuagtt

SEQ ID NO: 1619 - RNA, 19 nt, Artificial Sequence
  Description of Artificial Sequence: Synthetic oligonucleotide
acuaccugccagugucucu

SEQ ID NO: 1620 - RNA, 19 nt, Artificial Sequence
  Description of Artificial Sequence: Synthetic oligonucleotide
uuaggagugagguaccugg

SEQ ID NO: 1621 - RNA, 19 nt, Artificial Sequence
  Description of Artificial Sequence: Synthetic oligonucleotide
aaccugugacaaugacagc

SEQ ID NO: 1622 - RNA, 19 nt, Artificial Sequence
  Description of Artificial Sequence: Synthetic oligonucleotide
gcagacaaauugguuuucu

SEQ ID NO: 1623 - RNA, 19 nt, Artificial Sequence
  Description of Artificial Sequence: Synthetic oligonucleotide
uuugugaauggcagaaagg

SEQ ID NO: 1624 - RNA, 19 nt, Artificial Sequence
  Description of Artificial Sequence: Synthetic oligonucleotide
aaggugguggagaaaaaug

SEQ ID NO: 1625 - RNA, 19 nt, Artificial Sequence
  Description of Artificial Sequence: Synthetic oligonucleotide
ccuuuuggccuaccugaga

SEQ ID NO: 1626 - RNA, 19 nt, Artificial Sequence
  Description of Artificial Sequence: Synthetic oligonucleotide
aagaaaguuggggcugagu

SEQ ID NO: 1627 - RNA, 19 nt, Artificial Sequence
  Description of Artificial Sequence: Synthetic oligonucleotide
aguggaaccaagcucggcu

SEQ ID NO: 1628 - RNA, 19 nt, Artificial Sequence
  Description of Artificial Sequence: Synthetic oligonucleotide
cuguggagaggggggcugc

SEQ ID NO: 1629 - RNA, 19 nt, Artificial Sequence
  Description of Artificial Sequence: Synthetic oligonucleotide
cggggcuugcacagugaug

SEQ ID NO: 1630 - RNA, 19 nt, Artificial Sequence
  Description of Artificial Sequence: Synthetic oligonucleotide
augcucuccaaguaugauc

SEQ ID NO: 1631 - RNA, 19 nt, Artificial Sequence
  Description of Artificial Sequence: Synthetic oligonucleotide
ucguccacuuuucugccaa

SEQ ID NO: 1632 - RNA, 19 nt, Artificial Sequence
  Description of Artificial Sequence: Synthetic oligonucleotide
augccugccuggcccccau

SEQ ID NO: 1633 - RNA, 19 nt, Artificial Sequence
  Description of Artificial Sequence: Synthetic oligonucleotide
aucugcuccuugcaccaug

SEQ ID NO: 1634 - RNA, 19 nt, Artificial Sequence
  Description of Artificial Sequence: Synthetic oligonucleotide
uguugcagugacaacugug

SEQ ID NO: 1635 - RNA, 19 nt, Artificial Sequence
  Description of Artificial Sequence: Synthetic oligonucleotide
uggaaggaauaggaagcac

SEQ ID NO: 1636 - RNA, 19 nt, Artificial Sequence
  Description of Artificial Sequence: Synthetic oligonucleotide
caccaagacgaggcugcau

SEQ ID NO: 1637 - RNA, 19 nt, Artificial Sequence
  Description of Artificial Sequence: Synthetic oligonucleotide
uccugugcaggagagaauu

SEQ ID NO: 1638 - RNA, 19 nt, Artificial Sequence
  Description of Artificial Sequence: Synthetic oligonucleotide
auugccaaaagccacggcu

SEQ ID NO: 1639 - RNA, 19 nt, Artificial Sequence
  Description of Artificial Sequence: Synthetic oligonucleotide
ucccagugcggguucugca

SEQ ID NO: 1640 - RNA, 19 nt, Artificial Sequence
  Description of Artificial Sequence: Synthetic oligonucleotide
ugcaccccuggcaucguca

SEQ ID NO: 1641 - RNA, 19 nt, Artificial Sequence
  Description of Artificial Sequence: Synthetic oligonucleotide
ugaguauguacacacugcu

SEQ ID NO: 1642 - RNA, 19 nt, Artificial Sequence
  Description of Artificial Sequence: Synthetic oligonucleotide
ugcuccggaaucagcccga

SEQ ID NO: 1643 - RNA, 19 nt, Artificial Sequence
  Description of Artificial Sequence: Synthetic oligonucleotide
agcccaccauggaggagau

SEQ ID NO: 1644 - RNA, 19 nt, Artificial Sequence
  Description of Artificial Sequence: Synthetic oligonucleotide
uugagaaugccuuccaagg

SEQ ID NO: 1645 - RNA, 19 nt, Artificial Sequence
  Description of Artificial Sequence: Synthetic oligonucleotide
aaggaaaucugugccgcug

SEQ ID NO: 1646 - RNA, 19 nt, Artificial Sequence
  Description of Artificial Sequence: Synthetic oligonucleotide
cacaggcuacagacccauc

SEQ ID NO: 1647 - RNA, 19 nt, Artificial Sequence
  Description of Artificial Sequence: Synthetic oligonucleotide
cauccuccagggcuuccgg

SEQ ID NO: 1648 - RNA, 19 nt, Artificial Sequence
  Description of Artificial Sequence: Synthetic oligonucleotide
accuuugccagggauggug

SEQ ID NO: 1649 - RNA, 19 nt, Artificial Sequence
  Description of Artificial Sequence: Synthetic oligonucleotide
uggaugcuguggaggagau

SEQ ID NO: 1650 - RNA, 19 nt, Artificial Sequence
  Description of Artificial Sequence: Synthetic oligonucleotide
gaugggaauaauccaaauu

SEQ ID NO: 1651 - RNA, 19 nt, Artificial Sequence
  Description of Artificial Sequence: Synthetic oligonucleotide
agaaagaccacucagucag

SEQ ID NO: 1652 - RNA, 19 nt, Artificial Sequence
  Description of Artificial Sequence: Synthetic oligonucleotide
agccucucgccaucuuuau

SEQ ID NO: 1653 - RNA, 19 nt, Artificial Sequence
  Description of Artificial Sequence: Synthetic oligonucleotide
uauucaaaccagaggaguu

SEQ ID NO: 1654 - RNA, 19 nt, Artificial Sequence
  Description of Artificial Sequence: Synthetic oligonucleotide
uucacgccccuggauccaa

SEQ ID NO: 1655 - RNA, 19 nt, Artificial Sequence
  Description of Artificial Sequence: Synthetic oligonucleotide
aacccaggagcccauuuuu

SEQ ID NO: 1656 - RNA, 19 nt, Artificial Sequence
  Description of Artificial Sequence: Synthetic oligonucleotide
uucccccagaguugcugag

SEQ ID NO: 1657 - RNA, 19 nt, Artificial Sequence
  Description of Artificial Sequence: Synthetic oligonucleotide
aggcugaaagacacuccuc

SEQ ID NO: 1658 - RNA, 19 nt, Artificial Sequence
  Description of Artificial Sequence: Synthetic oligonucleotide
ucggaagcagcugcgauuu

SEQ ID NO: 1659 - RNA, 19 nt, Artificial Sequence
  Description of Artificial Sequence: Synthetic oligonucleotide
uugaaggggagcgugugac

SEQ ID NO: 1660 - RNA, 19 nt, Artificial Sequence
  Description of Artificial Sequence: Synthetic oligonucleotide
cguggauacaggccucaac

SEQ ID NO: 1661 - RNA, 19 nt, Artificial Sequence
  Description of Artificial Sequence: Synthetic oligonucleotide
aacccucaaggagcugcug

SEQ ID NO: 1662 - RNA, 19 nt, Artificial Sequence
  Description of Artificial Sequence: Synthetic oligonucleotide
uggaccucaaggcucagca

SEQ ID NO: 1663 - RNA, 19 nt, Artificial Sequence
  Description of Artificial Sequence: Synthetic oligonucleotide
acccugacgccaagcuggu

SEQ ID NO: 1664 - RNA, 19 nt, Artificial Sequence
  Description of Artificial Sequence: Synthetic oligonucleotide
ucguggggaacacggagau

SEQ ID NO: 1665 - RNA, 19 nt, Artificial Sequence
  Description of Artificial Sequence: Synthetic oligonucleotide
auuggcauugagaugaagu

SEQ ID NO: 1666 - RNA, 19 nt, Artificial Sequence
  Description of Artificial Sequence: Synthetic oligonucleotide
aaguucaagaauaugcugu

SEQ ID NO: 1667 - RNA, 19 nt, Artificial Sequence
  Description of Artificial Sequence: Synthetic oligonucleotide
uuuccuaugauugucugcc

SEQ ID NO: 1668 - RNA, 19 nt, Artificial Sequence
  Description of Artificial Sequence: Synthetic oligonucleotide
cccagccuggaucccugag

SEQ ID NO: 1669 - RNA, 19 nt, Artificial Sequence
  Description of Artificial Sequence: Synthetic oligonucleotide
agcugaauucgguagaaca

SEQ ID NO: 1670 - RNA, 19 nt, Artificial Sequence
  Description of Artificial Sequence: Synthetic oligonucleotide
cauggacccgacgguaucu

SEQ ID NO: 1671 - RNA, 19 nt, Artificial Sequence
  Description of Artificial Sequence: Synthetic oligonucleotide
ucuccuuuggagcugcuug

SEQ ID NO: 1672 - RNA, 19 nt, Artificial Sequence
  Description of Artificial Sequence: Synthetic oligonucleotide
ugcccccugagcauugugg

SEQ ID NO: 1673 - RNA, 19 nt, Artificial Sequence
  Description of Artificial Sequence: Synthetic oligonucleotide
aaaaaacccugguggaugc

SEQ ID NO: 1674 - RNA, 19 nt, Artificial Sequence
  Description of Artificial Sequence: Synthetic oligonucleotide
ugcuguugcuaagcuuccu

SEQ ID NO: 1675 - RNA, 19 nt, Artificial Sequence
  Description of Artificial Sequence: Synthetic oligonucleotide
ccugcccaaaagacagagg

SEQ ID NO: 1676 - RNA, 19 nt, Artificial Sequence
  Description of Artificial Sequence: Synthetic oligonucleotide
uguucagagggguccugga

SEQ ID NO: 1677 - RNA, 19 nt, Artificial Sequence
  Description of Artificial Sequence: Synthetic oligonucleotide
uggagcagcugcgcugguu

SEQ ID NO: 1678 - RNA, 19 nt, Artificial Sequence
  Description of Artificial Sequence: Synthetic oligonucleotide
uuugcugggaagcaaguca

SEQ ID NO: 1679 - RNA, 19 nt, Artificial Sequence
  Description of Artificial Sequence: Synthetic oligonucleotide
caagucuguggcguccguu

SEQ ID NO: 1680 - RNA, 19 nt, Artificial Sequence
  Description of Artificial Sequence: Synthetic oligonucleotide
uggagggaacaucaucacu

SEQ ID NO: 1681 - RNA, 19 nt, Artificial Sequence
  Description of Artificial Sequence: Synthetic oligonucleotide
ugccagccccaucuccgac

SEQ ID NO: 1682 - RNA, 19 nt, Artificial Sequence
  Description of Artificial Sequence: Synthetic oligonucleotide
accucaaccccguguucau

SEQ ID NO: 1683 - RNA, 19 nt, Artificial Sequence
  Description of Artificial Sequence: Synthetic oligonucleotide
ucauggccaguggggccaa

SEQ ID NO: 1684 - RNA, 19 nt, Artificial Sequence
  Description of Artificial Sequence: Synthetic oligonucleotide
aagcugacacuugugucca

SEQ ID NO: 1685 - RNA, 19 nt, Artificial Sequence
  Description of Artificial Sequence: Synthetic oligonucleotide
cagaggcaccaggagaacu

SEQ ID NO: 1686 - RNA, 19 nt, Artificial Sequence
  Description of Artificial Sequence: Synthetic oligonucleotide
uguccagauggaccacacc

SEQ ID NO: 1687 - RNA, 19 nt, Artificial Sequence
  Description of Artificial Sequence: Synthetic oligonucleotide
ccuucuucccuggcuacag

SEQ ID NO: 1688 - RNA, 19 nt, Artificial Sequence
  Description of Artificial Sequence: Synthetic oligonucleotide
agaaagacccugcugagcc

SEQ ID NO: 1689 - RNA, 19 nt, Artificial Sequence
  Description of Artificial Sequence: Synthetic oligonucleotide
ccggaggagauacugcucu

SEQ ID NO: 1690 - RNA, 19 nt, Artificial Sequence
  Description of Artificial Sequence: Synthetic oligonucleotide
cucuccauagagauccccu

SEQ ID NO: 1691 - RNA, 19 nt, Artificial Sequence
  Description of Artificial Sequence: Synthetic oligonucleotide
uacagcagggagggggagu

SEQ ID NO: 1692 - RNA, 19 nt, Artificial Sequence
  Description of Artificial Sequence: Synthetic oligonucleotide
aguauuucucagcauucaa

SEQ ID NO: 1693 - RNA, 19 nt, Artificial Sequence
  Description of Artificial Sequence: Synthetic oligonucleotide
aagcaggccucccggagag

SEQ ID NO: 1694 - RNA, 19 nt, Artificial Sequence
  Description of Artificial Sequence: Synthetic oligonucleotide
aagaugacauugccaaggu

SEQ ID NO: 1695 - RNA, 19 nt, Artificial Sequence
  Description of Artificial Sequence: Synthetic oligonucleotide
gguaaccaguggcaugaga

SEQ ID NO: 1696 - RNA, 19 nt, Artificial Sequence
  Description of Artificial Sequence: Synthetic oligonucleotide
agaguuuuauucaagccag

SEQ ID NO: 1697 - RNA, 19 nt, Artificial Sequence
  Description of Artificial Sequence: Synthetic oligonucleotide
aggaaccacagagguacag

SEQ ID NO: 1698 - RNA, 19 nt, Artificial Sequence
  Description of Artificial Sequence: Synthetic oligonucleotide
aggagcuggcccuuugcua

SEQ ID NO: 1699 - RNA, 19 nt, Artificial Sequence
  Description of Artificial Sequence: Synthetic oligonucleotide
uaugguggaauggccaaca

SEQ ID NO: 1700 - RNA, 19 nt, Artificial Sequence
  Description of Artificial Sequence: Synthetic oligonucleotide
agaaccaucucagcccuca

SEQ ID NO: 1701 - RNA, 19 nt, Artificial Sequence
  Description of Artificial Sequence: Synthetic oligonucleotide
aagaccacucagaggcagc

SEQ ID NO: 1702 - RNA, 19 nt, Artificial Sequence
  Description of Artificial Sequence: Synthetic oligonucleotide
cagcuuuccaagcucugga

SEQ ID NO: 1703 - RNA, 19 nt, Artificial Sequence
  Description of Artificial Sequence: Synthetic oligonucleotide
aggaggagcugcugcagga

SEQ ID NO: 1704 - RNA, 19 nt, Artificial Sequence
  Description of Artificial Sequence: Synthetic oligonucleotide
aggacgugugugcaggacu

SEQ ID NO: 1705 - RNA, 19 nt, Artificial Sequence
  Description of Artificial Sequence: Synthetic oligonucleotide
uggcagaggagcugcaucu

SEQ ID NO: 1706 - RNA, 19 nt, Artificial Sequence
  Description of Artificial Sequence: Synthetic oligonucleotide
ucugccucccgaugccccu

SEQ ID NO: 1707 - RNA, 19 nt, Artificial Sequence
  Description of Artificial Sequence: Synthetic oligonucleotide
gguggcaugguggacuucc

SEQ ID NO: 1708 - RNA, 19 nt, Artificial Sequence
  Description of Artificial Sequence: Synthetic oligonucleotide
uuccggugcacccucaccc

SEQ ID NO: 1709 - RNA, 19 nt, Artificial Sequence
  Description of Artificial Sequence: Synthetic oligonucleotide
ucagcuucuucuucaaguu

SEQ ID NO: 1710 - RNA, 19 nt, Artificial Sequence
  Description of Artificial Sequence: Synthetic oligonucleotide
uucuaccugacaguccuuc

SEQ ID NO: 1711 - RNA, 19 nt, Artificial Sequence
  Description of Artificial Sequence: Synthetic oligonucleotide
gagaaccuggaagacaagu

SEQ ID NO: 1712 - RNA, 19 nt, Artificial Sequence
  Description of Artificial Sequence: Synthetic oligonucleotide
ugugguaaacuggacccca

SEQ ID NO: 1713 - RNA, 19 nt, Artificial Sequence
  Description of Artificial Sequence: Synthetic oligonucleotide
cacuuucgccagugcaacu

SEQ ID NO: 1714 - RNA, 19 nt, Artificial Sequence
  Description of Artificial Sequence: Synthetic oligonucleotide
acuuuacuguuucagaaag

SEQ ID NO: 1715 - RNA, 19 nt, Artificial Sequence
  Description of Artificial Sequence: Synthetic oligonucleotide
aagaccccccagccgaugu

SEQ ID NO: 1716 - RNA, 19 nt, Artificial Sequence
  Description of Artificial Sequence: Synthetic oligonucleotide
uccagcucuuccaagaggu

SEQ ID NO: 1717 - RNA, 19 nt, Artificial Sequence
  Description of Artificial Sequence: Synthetic oligonucleotide
ugcccaagggucagucuga

SEQ ID NO: 1718 - RNA, 19 nt, Artificial Sequence
  Description of Artificial Sequence: Synthetic oligonucleotide
gaggaggacauggugggcc

SEQ ID NO: 1719 - RNA, 19 nt, Artificial Sequence
  Description of Artificial Sequence: Synthetic oligonucleotide
gccggccccugccccaccu

SEQ ID NO: 1720 - RNA, 19 nt, Artificial Sequence
  Description of Artificial Sequence: Synthetic oligonucleotide
ccuggcagcggacaugcag

SEQ ID NO: 1721 - RNA, 19 nt, Artificial Sequence
  Description of Artificial Sequence: Synthetic oligonucleotide
aggccucuggugaggccgu

SEQ ID NO: 1722 - RNA, 19 nt, Artificial Sequence
  Description of Artificial Sequence: Synthetic oligonucleotide
uguacugugacgacauucc

SEQ ID NO: 1723 - RNA, 19 nt, Artificial Sequence
  Description of Artificial Sequence: Synthetic oligonucleotide
cucgcuacgagaaugagcu

SEQ ID NO: 1724 - RNA, 19 nt, Artificial Sequence
  Description of Artificial Sequence: Synthetic oligonucleotide
cugucucuccggcugguca

SEQ ID NO: 1725 - RNA, 19 nt, Artificial Sequence
  Description of Artificial Sequence: Synthetic oligonucleotide
ccacgccaagaucaagucc

SEQ ID NO: 1726 - RNA, 19 nt, Artificial Sequence
  Description of Artificial Sequence: Synthetic oligonucleotide
cauagauacaucagaagcu

SEQ ID NO: 1727 - RNA, 19 nt, Artificial Sequence
  Description of Artificial Sequence: Synthetic oligonucleotide
uuuguuuguuucauuuccg

SEQ ID NO: 1728 - RNA, 19 nt, Artificial Sequence
  Description of Artificial Sequence: Synthetic oligonucleotide
gcugaugauguuccuggga

SEQ ID NO: 1729 - RNA, 19 nt, Artificial Sequence
  Description of Artificial Sequence: Synthetic oligonucleotide
cagucuuugcgaaggauaa

SEQ ID NO: 1730 - RNA, 19 nt, Artificial Sequence
  Description of Artificial Sequence: Synthetic oligonucleotide
aagguuacuuguguugggc

SEQ ID NO: 1731 - RNA, 19 nt, Artificial Sequence
  Description of Artificial Sequence: Synthetic oligonucleotide
cauaucauuggugcugugg

SEQ ID NO: 1732 - RNA, 19 nt, Artificial Sequence
  Description of Artificial Sequence: Synthetic oligonucleotide
ugguugcugacaccccgga

SEQ ID NO: 1733 - RNA, 19 nt, Artificial Sequence
  Description of Artificial Sequence: Synthetic oligonucleotide
acacacacagagagcugcc

SEQ ID NO: 1734 - RNA, 19 nt, Artificial Sequence
  Description of Artificial Sequence: Synthetic oligonucleotide
gcccaaggggugaaaauca

SEQ ID NO: 1735 - RNA, 19 nt, Artificial Sequence
  Description of Artificial Sequence: Synthetic oligonucleotide
ucaccuaugaagaacuacc

SEQ ID NO: 1736 - RNA, 19 nt, Artificial Sequence
  Description of Artificial Sequence: Synthetic oligonucleotide
gaggaugcuauaaagaaca

SEQ ID NO: 1737 - RNA, 19 nt, Artificial Sequence
  Description of Artificial Sequence: Synthetic oligonucleotide
caacuccuuuuauggaccu

SEQ ID NO: 1738 - RNA, 19 nt, Artificial Sequence
  Description of Artificial Sequence: Synthetic oligonucleotide
ccugagcugaagaucgaga

SEQ ID NO: 1739 - RNA, 19 nt, Artificial Sequence
  Description of Artificial Sequence: Synthetic oligonucleotide
aaaggggaccuaaagaagg

SEQ ID NO: 1740 - RNA, 19 nt, Artificial Sequence
  Description of Artificial Sequence: Synthetic oligonucleotide
agggguuuuccgaagcaga

SEQ ID NO: 1741 - RNA, 19 nt, Artificial Sequence
  Description of Artificial Sequence: Synthetic oligonucleotide
uaauguugugucaggggag

SEQ ID NO: 1742 - RNA, 19 nt, Artificial Sequence
  Description of Artificial Sequence: Synthetic oligonucleotide
agauauacaucgguggcca

SEQ ID NO: 1743 - RNA, 19 nt, Artificial Sequence
  Description of Artificial Sequence: Synthetic oligonucleotide
gccaagagcacuucuaccu

SEQ ID NO: 1744 - RNA, 19 nt, Artificial Sequence
  Description of Artificial Sequence: Synthetic oligonucleotide
ggagacucacugcaccauu

SEQ ID NO: 1745 - RNA, 19 nt, Artificial Sequence
  Description of Artificial Sequence: Synthetic oligonucleotide
uugcuguuccaaaaggcga

SEQ ID NO: 1746 - RNA, 19 nt, Artificial Sequence
  Description of Artificial Sequence: Synthetic oligonucleotide
cgaggcaggggagauggag

SEQ ID NO: 1747 - RNA, 19 nt, Artificial Sequence
  Description of Artificial Sequence: Synthetic oligonucleotide
agcucuuugugucuacaca

SEQ ID NO: 1748 - RNA, 19 nt, Artificial Sequence
  Description of Artificial Sequence: Synthetic oligonucleotide
cagaacaccaugaagaccc

SEQ ID NO: 1749 - RNA, 19 nt, Artificial Sequence
  Description of Artificial Sequence: Synthetic oligonucleotide
cagagcuuuguugcaaaaa

SEQ ID NO: 1750 - RNA, 19 nt, Artificial Sequence
  Description of Artificial Sequence: Synthetic oligonucleotide
aaaauguuggggguuccag

SEQ ID NO: 1751 - RNA, 19 nt, Artificial Sequence
  Description of Artificial Sequence: Synthetic oligonucleotide
agcaaaccggauugugguu

SEQ ID NO: 1752 - RNA, 19 nt, Artificial Sequence
  Description of Artificial Sequence: Synthetic oligonucleotide
uucgagugaagagaauggg

SEQ ID NO: 1753 - RNA, 19 nt, Artificial Sequence
  Description of Artificial Sequence: Synthetic oligonucleotide
aggaggcuuuggaggcaag

SEQ ID NO: 1754 - RNA, 19 nt, Artificial Sequence
  Description of Artificial Sequence: Synthetic oligonucleotide
aaggagacccggagcacug

SEQ ID NO: 1755 - RNA, 19 nt, Artificial Sequence
  Description of Artificial Sequence: Synthetic oligonucleotide
ugugguguccacggcagug

SEQ ID NO: 1756 - RNA, 19 nt, Artificial Sequence
  Description of Artificial Sequence: Synthetic oligonucleotide
uggcccuggcugcauauaa

SEQ ID NO: 1757 - RNA, 19 nt, Artificial Sequence
  Description of Artificial Sequence: Synthetic oligonucleotide
ugcgaugcaugcuggaccg

SEQ ID NO: 1758 - RNA, 19 nt, Artificial Sequence
  Description of Artificial Sequence: Synthetic oligonucleotide
cgugaugaggacaugcuga

SEQ ID NO: 1759 - RNA, 19 nt, Artificial Sequence
  Description of Artificial Sequence: Synthetic oligonucleotide
uaacugguggcagacaucc

SEQ ID NO: 1760 - RNA, 19 nt, Artificial Sequence
  Description of Artificial Sequence: Synthetic oligonucleotide
ucccuuccuggccagauac

SEQ ID NO: 1761 - RNA, 19 nt, Artificial Sequence
  Description of Artificial Sequence: Synthetic oligonucleotide
uacaagguuggcuucauga

SEQ ID NO: 1762 - RNA, 19 nt, Artificial Sequence
  Description of Artificial Sequence: Synthetic oligonucleotide
agacugggacaguuguggc

SEQ ID NO: 1763 - RNA, 19 nt, Artificial Sequence
  Description of Artificial Sequence: Synthetic oligonucleotide
gcucuugagguggaccacu

SEQ ID NO: 1764 - RNA, 19 nt, Artificial Sequence
  Description of Artificial Sequence: Synthetic oligonucleotide
acuucagcaauguggggaa

SEQ ID NO: 1765 - RNA, 19 nt, Artificial Sequence
  Description of Artificial Sequence: Synthetic oligonucleotide
gaacacccaggaucucucu

SEQ ID NO: 1766 - RNA, 19 nt, Artificial Sequence
  Description of Artificial Sequence: Synthetic oligonucleotide
cagaguauuauggaacgag

SEQ ID NO: 1767 - RNA, 19 nt, Artificial Sequence
  Description of Artificial Sequence: Synthetic oligonucleotide
agcuuuauuccacauggac

SEQ ID NO: 1768 - RNA, 19 nt, Artificial Sequence
  Description of Artificial Sequence: Synthetic oligonucleotide
acaacugcuauaaaauccc

SEQ ID NO: 1769 - RNA, 19 nt, Artificial Sequence
  Description of Artificial Sequence: Synthetic oligonucleotide
uccccaacauccggggcac

SEQ ID NO: 1770 - RNA, 19 nt, Artificial Sequence
  Description of Artificial Sequence: Synthetic oligonucleotide
ugggcggcugugcaaaacc

SEQ ID NO: 1771 - RNA, 19 nt, Artificial Sequence
  Description of Artificial Sequence: Synthetic oligonucleotide
aaccaaccuucccuccaac

SEQ ID NO: 1772 - RNA, 19 nt, Artificial Sequence
  Description of Artificial Sequence: Synthetic oligonucleotide
acacggccuuccggggcuu

SEQ ID NO: 1773 - RNA, 19 nt, Artificial Sequence
  Description of Artificial Sequence: Synthetic oligonucleotide
uuggggggccccaggggau

SEQ ID NO: 1774 - RNA, 19 nt, Artificial Sequence
  Description of Artificial Sequence: Synthetic oligonucleotide
augcucauugccgagugcu

SEQ ID NO: 1775 - RNA, 19 nt, Artificial Sequence
  Description of Artificial Sequence: Synthetic oligonucleotide
uggaugagugaaguugcag

SEQ ID NO: 1776 - RNA, 19 nt, Artificial Sequence
  Description of Artificial Sequence: Synthetic oligonucleotide
agugaccugugggaugccu

SEQ ID NO: 1777 - RNA, 19 nt, Artificial Sequence
  Description of Artificial Sequence: Synthetic oligonucleotide
ccugcagaggaggugcgga

SEQ ID NO: 1778 - RNA, 19 nt, Artificial Sequence
  Description of Artificial Sequence: Synthetic oligonucleotide
agaaaaaaccuguacaaag

SEQ ID NO: 1779 - RNA, 19 nt, Artificial Sequence
  Description of Artificial Sequence: Synthetic oligonucleotide
aaagaaggggaccugacac

SEQ ID NO: 1780 - RNA, 19 nt, Artificial Sequence
  Description of Artificial Sequence: Synthetic oligonucleotide
acacuucaaccagaagcuu

SEQ ID NO: 1781 - RNA, 19 nt, Artificial Sequence
  Description of Artificial Sequence: Synthetic oligonucleotide
uugaggguuucaccuugcc

SEQ ID NO: 1782 - RNA, 19 nt, Artificial Sequence
  Description of Artificial Sequence: Synthetic oligonucleotide
cagaugcugggaagaaugc

SEQ ID NO: 1783 - RNA, 19 nt, Artificial Sequence
  Description of Artificial Sequence: Synthetic oligonucleotide
ugccuagcaagcucucagu

SEQ ID NO: 1784 - RNA, 19 nt, Artificial Sequence
  Description of Artificial Sequence: Synthetic oligonucleotide
uaucaugcucggaagagug

SEQ ID NO: 1785 - RNA, 19 nt, Artificial Sequence
  Description of Artificial Sequence: Synthetic oligonucleotide
agugagguugacaaguuca

SEQ ID NO: 1786 - RNA, 19 nt, Artificial Sequence
  Description of Artificial Sequence: Synthetic oligonucleotide
aacaaggagaauuguugga

SEQ ID NO: 1787 - RNA, 19 nt, Artificial Sequence
  Description of Artificial Sequence: Synthetic oligonucleotide
aaaaagagaggauugugca

SEQ ID NO: 1788 - RNA, 19 nt, Artificial Sequence
  Description of Artificial Sequence: Synthetic oligonucleotide
cauaauucccaccaaguuu

SEQ ID NO: 1789 - RNA, 19 nt, Artificial Sequence
  Description of Artificial Sequence: Synthetic oligonucleotide
uuuggaauaagcuuuacag

SEQ ID NO: 1790 - RNA, 19 nt, Artificial Sequence
  Description of Artificial Sequence: Synthetic oligonucleotide
aguuccuuuucugaaucag

SEQ ID NO: 1791 - RNA, 19 nt, Artificial Sequence
  Description of Artificial Sequence: Synthetic oligonucleotide
aggcaggagcccuacuuca

SEQ ID NO: 1792 - RNA, 19 nt, Artificial Sequence
  Description of Artificial Sequence: Synthetic oligonucleotide
cauguguacacagauggcu

SEQ ID NO: 1793 - RNA, 19 nt, Artificial Sequence
  Description of Artificial Sequence: Synthetic oligonucleotide
ucugugcugcugacccacg

SEQ ID NO: 1794 - RNA, 19 nt, Artificial Sequence
  Description of Artificial Sequence: Synthetic oligonucleotide
ggccaaggccuucauacca

SEQ ID NO: 1795 - RNA, 19 nt, Artificial Sequence
  Description of Artificial Sequence: Synthetic oligonucleotide
aaaaugguccagguggcca

SEQ ID NO: 1796 - RNA, 19 nt, Artificial Sequence
  Description of Artificial Sequence: Synthetic oligonucleotide
gccaguagagcucugaaaa

SEQ ID NO: 1797 - RNA, 19 nt, Artificial Sequence
  Description of Artificial Sequence: Synthetic oligonucleotide
aauccccaccucuaagauu

SEQ ID NO: 1798 - RNA, 19 nt, Artificial Sequence
  Description of Artificial Sequence: Synthetic oligonucleotide
uauaucagcgagacaagca

SEQ ID NO: 1799 - RNA, 19 nt, Artificial Sequence
  Description of Artificial Sequence: Synthetic oligonucleotide
agcacuaacacugugccca

SEQ ID NO: 1800 - RNA, 19 nt, Artificial Sequence
  Description of Artificial Sequence: Synthetic oligonucleotide
caacaccucucccacggcu

SEQ ID NO: 1801 - RNA, 19 nt, Artificial Sequence
  Description of Artificial Sequence: Synthetic oligonucleotide
ugccucugucagcgcugac

SEQ ID NO: 1802 - RNA, 19 nt, Artificial Sequence
  Description of Artificial Sequence: Synthetic oligonucleotide
accucaauggacaggccgu

SEQ ID NO: 1803 - RNA, 19 nt, Artificial Sequence
  Description of Artificial Sequence: Synthetic oligonucleotide
gucuaugcggcuugucaga

SEQ ID NO: 1804 - RNA, 19 nt, Artificial Sequence
  Description of Artificial Sequence: Synthetic oligonucleotide
agaccaucuugaaaaggcu

SEQ ID NO: 1805 - RNA, 19 nt, Artificial Sequence
  Description of Artificial Sequence: Synthetic oligonucleotide
uggaacccuacaagaagaa

SEQ ID NO: 1806 - RNA, 19 nt, Artificial Sequence
  Description of Artificial Sequence: Synthetic oligonucleotide
aagaaucccaguggcuccu

SEQ ID NO: 1807 - RNA, 19 nt, Artificial Sequence
  Description of Artificial Sequence: Synthetic oligonucleotide
ugggaagacugggucacag

SEQ ID NO: 1808 - RNA, 19 nt, Artificial Sequence
  Description of Artificial Sequence: Synthetic oligonucleotide
acagcugccuacauggaca

SEQ ID NO: 1809 - RNA, 19 nt, Artificial Sequence
  Description of Artificial Sequence: Synthetic oligonucleotide
acagugagcuugucugcca

SEQ ID NO: 1810 - RNA, 19 nt, Artificial Sequence
  Description of Artificial Sequence: Synthetic oligonucleotide
acuggguuuuauagaacac

SEQ ID NO: 1811 - RNA, 19 nt, Artificial Sequence
  Description of Artificial Sequence: Synthetic oligonucleotide
acccaaucugggcuacagc

SEQ ID NO: 1812 - RNA, 19 nt, Artificial Sequence
  Description of Artificial Sequence: Synthetic oligonucleotide
cagcuuugagacuaacuca

SEQ ID NO: 1813 - RNA, 19 nt, Artificial Sequence
  Description of Artificial Sequence: Synthetic oligonucleotide
gggaaccccuuccacuacu

SEQ ID NO: 1814 - RNA, 19 nt, Artificial Sequence
  Description of Artificial Sequence: Synthetic oligonucleotide
cuucagcuaugggguggcu

SEQ ID NO: 1815 - RNA, 19 nt, Artificial Sequence
  Description of Artificial Sequence: Synthetic oligonucleotide
cuugcucugaaguagaaau

SEQ ID NO: 1816 - RNA, 19 nt, Artificial Sequence
  Description of Artificial Sequence: Synthetic oligonucleotide
aaaucgacugccuaacagg

SEQ ID NO: 1817 - RNA, 19 nt, Artificial Sequence
  Description of Artificial Sequence: Synthetic oligonucleotide
gagaucauaagaaccuccg

SEQ ID NO: 1818 - RNA, 19 nt, Artificial Sequence
  Description of Artificial Sequence: Synthetic oligonucleotide
gcacagauauugucaugga

SEQ ID NO: 1819 - RNA, 19 nt, Artificial Sequence
  Description of Artificial Sequence: Synthetic oligonucleotide
uggauguuggcuccagucu

SEQ ID NO: 1820 - RNA, 19 nt, Artificial Sequence
  Description of Artificial Sequence: Synthetic oligonucleotide
uaaacccugccauugauau

SEQ ID NO: 1821 - RNA, 19 nt, Artificial Sequence
  Description of Artificial Sequence: Synthetic oligonucleotide
uuggacagguggaaggggc

SEQ ID NO: 1822 - RNA, 19 nt, Artificial Sequence
  Description of Artificial Sequence: Synthetic oligonucleotide
gggcauuuguccagggccu

SEQ ID NO: 1823 - RNA, 19 nt, Artificial Sequence
  Description of Artificial Sequence: Synthetic oligonucleotide
uuggccucuucacccuaga

SEQ ID NO: 1824 - RNA, 19 nt, Artificial Sequence
  Description of Artificial Sequence: Synthetic oligonucleotide
agaggagcuacacuauucc

SEQ ID NO: 1825 - RNA, 19 nt, Artificial Sequence
  Description of Artificial Sequence: Synthetic oligonucleotide
ccccgaggggagccugcac

SEQ ID NO: 1826 - RNA, 19 nt, Artificial Sequence
  Description of Artificial Sequence: Synthetic oligonucleotide
cacacccguggcccuagca

SEQ ID NO: 1827 - RNA, 19 nt, Artificial Sequence
  Description of Artificial Sequence: Synthetic oligonucleotide
accuacaagaucccggcau

SEQ ID NO: 1828 - RNA, 19 nt, Artificial Sequence
  Description of Artificial Sequence: Synthetic oligonucleotide
uuuggcagcauccccauug

SEQ ID NO: 1829 - RNA, 19 nt, Artificial Sequence
  Description of Artificial Sequence: Synthetic oligonucleotide
ccugcuccgcgacugcccc

SEQ ID NO: 1830 - RNA, 19 nt, Artificial Sequence
  Description of Artificial Sequence: Synthetic oligonucleotide
caacaagaaggccaucuau

SEQ ID NO: 1831 - RNA, 19 nt, Artificial Sequence
  Description of Artificial Sequence: Synthetic oligonucleotide
uaugcaucgaaggcuguug

SEQ ID NO: 1832 - RNA, 19 nt, Artificial Sequence
  Description of Artificial Sequence: Synthetic oligonucleotide
uggagagccgccccucuuc

SEQ ID NO: 1833 - RNA, 19 nt, Artificial Sequence
  Description of Artificial Sequence: Synthetic oligonucleotide
uccuggcugcuucuaucuu

SEQ ID NO: 1834 - RNA, 19 nt, Artificial Sequence
  Description of Artificial Sequence: Synthetic oligonucleotide
uucuuugccaucaaagaug

SEQ ID NO: 1835 - RNA, 19 nt, Artificial Sequence
  Description of Artificial Sequence: Synthetic oligonucleotide
ccauccgugcagcucgagc

SEQ ID NO: 1836 - RNA, 19 nt, Artificial Sequence
  Description of Artificial Sequence: Synthetic oligonucleotide
agcucagcacacagguaau

SEQ ID NO: 1837 - RNA, 19 nt, Artificial Sequence
  Description of Artificial Sequence: Synthetic oligonucleotide
aauaacgugaaggaacucu

SEQ ID NO: 1838 - RNA, 19 nt, Artificial Sequence
  Description of Artificial Sequence: Synthetic oligonucleotide
uuccggcuagacagcccug

SEQ ID NO: 1839 - RNA, 19 nt, Artificial Sequence
  Description of Artificial Sequence: Synthetic oligonucleotide
ugccaccccggagaagauc

SEQ ID NO: 1840 - RNA, 19 nt, Artificial Sequence
  Description of Artificial Sequence: Synthetic oligonucleotide
auccgcaaugccugcgugg

SEQ ID NO: 1841 - RNA, 19 nt, Artificial Sequence
  Description of Artificial Sequence: Synthetic oligonucleotide
gacaaguucaccacccugu

SEQ ID NO: 1842 - RNA, 19 nt, Artificial Sequence
  Description of Artificial Sequence: Synthetic oligonucleotide
ugugugucacugguguccc

SEQ ID NO: 1843 - RNA, 19 nt, Artificial Sequence
  Description of Artificial Sequence: Synthetic oligonucleotide
agaaaacugcaaacccugg

SEQ ID NO: 1844 - RNA, 19 nt, Artificial Sequence
  Description of Artificial Sequence: Synthetic oligonucleotide
cuggucugugagggucuaa

SEQ ID NO: 1845 - RNA, 19 nt, Artificial Sequence
  Description of Artificial Sequence: Synthetic oligonucleotide
aaagagagaguccucagca

SEQ ID NO: 1846 - RNA, 19 nt, Artificial Sequence
  Description of Artificial Sequence: Synthetic oligonucleotide
agagucuucuugugcugcc

SEQ ID NO: 1847 - RNA, 19 nt, Artificial Sequence
  Description of Artificial Sequence: Synthetic oligonucleotide
gccuuugggcuuccaugga

SEQ ID NO: 1848 - RNA, 19 nt, Artificial Sequence
  Description of Artificial Sequence: Synthetic oligonucleotide
cagaacauggaucuauuaa

SEQ ID NO: 1849 - RNA, 19 nt, Artificial Sequence
  Description of Artificial Sequence: Synthetic oligonucleotide
uuaaagucacagaaugaca

SEQ ID NO: 1850 - RNA, 19 nt, Artificial Sequence
  Description of Artificial Sequence: Synthetic oligonucleotide
agaccugugauuugucaag

SEQ ID NO: 1851 - RNA, 19 nt, Artificial Sequence
  Description of Artificial Sequence: Synthetic oligonucleotide
agaugggauuuggaagaca

SEQ ID NO: 1852 - RNA, 19 nt, Artificial Sequence
  Description of Artificial Sequence: Synthetic oligonucleotide
aagugaaugcaauggaaga

SEQ ID NO: 1853 - RNA, 19 nt, Artificial Sequence
  Description of Artificial Sequence: Synthetic oligonucleotide
aagauuuugaucaaaaaug

SEQ ID NO: 1854 - RNA, 19 nt, Artificial Sequence
  Description of Artificial Sequence: Synthetic oligonucleotide
uguaauuuguaaacacaau

SEQ ID NO: 1855 - RNA, 19 nt, Artificial Sequence
  Description of Artificial Sequence: Synthetic oligonucleotide
gauaagcaaauucaaaacu

SEQ ID NO: 1856 - RNA, 19 nt, Artificial Sequence
  Description of Artificial Sequence: Synthetic oligonucleotide
acuguuaugccuaaauggu

SEQ ID NO: 1857 - RNA, 19 nt, Artificial Sequence
  Description of Artificial Sequence: Synthetic oligonucleotide
ugaauaugcaauuaggauc

SEQ ID NO: 1858 - RNA, 19 nt, Artificial Sequence
  Description of Artificial Sequence: Synthetic oligonucleotide
aucauuuucugucuguuuu

SEQ ID NO: 1859 - RNA, 19 nt, Artificial Sequence
  Description of Artificial Sequence: Synthetic oligonucleotide
uuaaucauguaucuggaau

SEQ ID NO: 1860 - RNA, 19 nt, Artificial Sequence
  Description of Artificial Sequence: Synthetic oligonucleotide
aauagggucgggaaggguu

SEQ ID NO: 1861 - RNA, 19 nt, Artificial Sequence
  Description of Artificial Sequence: Synthetic oligonucleotide
uuugugcuauuccccacuu

SEQ ID NO: 1862 - RNA, 19 nt, Artificial Sequence
  Description of Artificial Sequence: Synthetic oligonucleotide
uuacuggacagccuguaua

SEQ ID NO: 1863 - RNA, 19 nt, Artificial Sequence
  Description of Artificial Sequence: Synthetic oligonucleotide
aaccucaaguucugauggu

SEQ ID NO: 1864 - RNA, 19 nt, Artificial Sequence
  Description of Artificial Sequence: Synthetic oligonucleotide
ugucuguccuuugaagagg

SEQ ID NO: 1865 - RNA, 19 nt, Artificial Sequence
  Description of Artificial Sequence: Synthetic oligonucleotide
aggauucccacaaaccucu

SEQ ID NO: 1866 - RNA, 19 nt, Artificial Sequence
  Description of Artificial Sequence: Synthetic oligonucleotide
uagaagcuuaaaccgaagu

SEQ ID NO: 1867 - RNA, 19 nt, Artificial Sequence
  Description of Artificial Sequence: Synthetic oligonucleotide
aaguuacuuuaaaucgugu

SEQ ID NO: 1868 - RNA, 19 nt, Artificial Sequence
  Description of Artificial Sequence: Synthetic oligonucleotide
ugccuuccugugaaagccu

SEQ ID NO: 1869 - RNA, 19 nt, Artificial Sequence
  Description of Artificial Sequence: Synthetic oligonucleotide
cuggccuucaaaccaauga

SEQ ID NO: 1870 - RNA, 19 nt, Artificial Sequence
  Description of Artificial Sequence: Synthetic oligonucleotide
aacagcaaagcauaaccuu

SEQ ID NO: 1871 - RNA, 19 nt, Artificial Sequence
  Description of Artificial Sequence: Synthetic oligonucleotide
uugaaucuauacucaaauu

SEQ ID NO: 1872 - RNA, 19 nt, Artificial Sequence
  Description of Artificial Sequence: Synthetic oligonucleotide
uuuugcaaugaggcagugg

SEQ ID NO: 1873 - RNA, 19 nt, Artificial Sequence
  Description of Artificial Sequence: Synthetic oligonucleotide
ugggguaagguuaaauccu

SEQ ID NO: 1874 - RNA, 19 nt, Artificial Sequence
  Description of Artificial Sequence: Synthetic oligonucleotide
ucuaaccaucuuugaauca

SEQ ID NO: 1875 - RNA, 19 nt, Artificial Sequence
  Description of Artificial Sequence: Synthetic oligonucleotide
aucauuggaaagaauaaag

SEQ ID NO: 1876 - RNA, 19 nt, Artificial Sequence
  Description of Artificial Sequence: Synthetic oligonucleotide
aaugaaacaaauucaaggu

SEQ ID NO: 1877 - RNA, 19 nt, Artificial Sequence
  Description of Artificial Sequence: Synthetic oligonucleotide
agguuaauuggaucugauu

SEQ ID NO: 1878 - RNA, 19 nt, Artificial Sequence
  Description of Artificial Sequence: Synthetic oligonucleotide
uuugugaagcugcauaaag

SEQ ID NO: 1879 - RNA, 19 nt, Artificial Sequence
  Description of Artificial Sequence: Synthetic oligonucleotide
agcaagauuacucuauaau

SEQ ID NO: 1880 - RNA, 19 nt, Artificial Sequence
  Description of Artificial Sequence: Synthetic oligonucleotide
uacaaaaauccaaccaacu

SEQ ID NO: 1881 - RNA, 19 nt, Artificial Sequence
  Description of Artificial Sequence: Synthetic oligonucleotide
acucaauuauugagcacgu

SEQ ID NO: 1882 - RNA, 19 nt, Artificial Sequence
  Description of Artificial Sequence: Synthetic oligonucleotide
uacaauguucuagauuucu

SEQ ID NO: 1883 - RNA, 19 nt, Artificial Sequence
  Description of Artificial Sequence: Synthetic oligonucleotide
uucuuucccuuccucuuug

SEQ ID NO: 1884 - RNA, 19 nt, Artificial Sequence
  Description of Artificial Sequence: Synthetic oligonucleotide
gaagagaauauuuguauuc

SEQ ID NO: 1885 - RNA, 19 nt, Artificial Sequence
  Description of Artificial Sequence: Synthetic oligonucleotide
uuccaaauacucuuugagu

SEQ ID NO: 1886 - RNA, 19 nt, Artificial Sequence
  Description of Artificial Sequence: Synthetic oligonucleotide
uauuuacaaaaaagauuau

SEQ ID NO: 1887 - RNA, 19 nt, Artificial Sequence
  Description of Artificial Sequence: Synthetic oligonucleotide
uauguuuaaucuuuacauu

SEQ ID NO: 1888 - RNA, 19 nt, Artificial Sequence
  Description of Artificial Sequence: Synthetic oligonucleotide
uuugaagccaaaguaauuu

SEQ ID NO: 1889 - RNA, 19 nt, Artificial Sequence
  Description of Artificial Sequence: Synthetic oligonucleotide
uuccaccuagaaaugaugc

SEQ ID NO: 1890 - RNA, 19 nt, Artificial Sequence
  Description of Artificial Sequence: Synthetic oligonucleotide
uaucaguccuggcauggug

SEQ ID NO: 1891 - RNA, 19 nt, Artificial Sequence
  Description of Artificial Sequence: Synthetic oligonucleotide
uggcucaccccuauaaucc

SEQ ID NO: 1892 - RNA, 19 nt, Artificial Sequence
  Description of Artificial Sequence: Synthetic oligonucleotide
aucccagcacuuugggagg

SEQ ID NO: 1893 - RNA, 19 nt, Artificial Sequence
  Description of Artificial Sequence: Synthetic oligonucleotide
cuaaggcaggagaauugcu

SEQ ID NO: 1894 - RNA, 19 nt, Artificial Sequence
  Description of Artificial Sequence: Synthetic oligonucleotide
ugcuugagcccagcaguuu

SEQ ID NO: 1895 - RNA, 19 nt, Artificial Sequence
  Description of Artificial Sequence: Synthetic oligonucleotide
uugagaccagccugggcaa

SEQ ID NO: 1896 - RNA, 19 nt, Artificial Sequence
  Description of Artificial Sequence: Synthetic oligonucleotide
acauagagagcuccugucu

SEQ ID NO: 1897 - RNA, 19 nt, Artificial Sequence
  Description of Artificial Sequence: Synthetic oligonucleotide
ucuuuaaaaaaaauuuuuu

SEQ ID NO: 1898 - RNA, 19 nt, Artificial Sequence
  Description of Artificial Sequence: Synthetic oligonucleotide
uuaauuaguuggucuugau

SEQ ID NO: 1899 - RNA, 19 nt, Artificial Sequence
  Description of Artificial Sequence: Synthetic oligonucleotide
uagugcaugccuguagucc

SEQ ID NO: 1900 - RNA, 19 nt, Artificial Sequence
  Description of Artificial Sequence: Synthetic oligonucleotide
cccaacuacuugaaaggcu

SEQ ID NO: 1901 - RNA, 19 nt, Artificial Sequence
  Description of Artificial Sequence: Synthetic oligonucleotide
cugagguggagagaucauu

SEQ ID NO: 1902 - RNA, 19 nt, Artificial Sequence
  Description of Artificial Sequence: Synthetic oligonucleotide
uuugagcucaggagguuga

SEQ ID NO: 1903 - RNA, 19 nt, Artificial Sequence
  Description of Artificial Sequence: Synthetic oligonucleotide
uugaggcugcagugagcua

SEQ ID NO: 1904 - RNA, 19 nt, Artificial Sequence
  Description of Artificial Sequence: Synthetic oligonucleotide
cuccugccugagcgacuga

SEQ ID NO: 1905 - RNA, 19 nt, Artificial Sequence
  Description of Artificial Sequence: Synthetic oligonucleotide
ugagcaagaucuugucucu

SEQ ID NO: 1906 - RNA, 19 nt, Artificial Sequence
  Description of Artificial Sequence: Synthetic oligonucleotide
ugaagaaaaaaaaagaaau

SEQ ID NO: 1907 - RNA, 19 nt, Artificial Sequence
  Description of Artificial Sequence: Synthetic oligonucleotide
uaaaaaugcugcuaucaaa

SEQ ID NO: 1908 - RNA, 19 nt, Artificial Sequence
  Description of Artificial Sequence: Synthetic oligonucleotide
aaaaucaagcccaaccaga

SEQ ID NO: 1909 - RNA, 19 nt, Artificial Sequence
  Description of Artificial Sequence: Synthetic oligonucleotide
agagguagaagagccaaga

SEQ ID NO: 1910 - RNA, 19 nt, Artificial Sequence
  Description of Artificial Sequence: Synthetic oligonucleotide
aagccuggguucucauccu

SEQ ID NO: 1911 - RNA, 19 nt, Artificial Sequence
  Description of Artificial Sequence: Synthetic oligonucleotide
cuagcucugucucuucugu

SEQ ID NO: 1912 - RNA, 19 nt, Artificial Sequence
  Description of Artificial Sequence: Synthetic oligonucleotide
uuggacugucaauuccccu

SEQ ID NO: 1913 - RNA, 19 nt, Artificial Sequence
  Description of Artificial Sequence: Synthetic oligonucleotide
ccuuccugugauccauuuu

SEQ ID NO: 1914 - RNA, 19 nt, Artificial Sequence
  Description of Artificial Sequence: Synthetic oligonucleotide
ucucacgucuucugcuuua

SEQ ID NO: 1915 - RNA, 19 nt, Artificial Sequence
  Description of Artificial Sequence: Synthetic oligonucleotide
uaugaccugaaaacuccag

SEQ ID NO: 1916 - RNA, 19 nt, Artificial Sequence
  Description of Artificial Sequence: Synthetic oligonucleotide
uuacauaaaggaucugcag

SEQ ID NO: 1917 - RNA, 19 nt, Artificial Sequence
  Description of Artificial Sequence: Synthetic oligonucleotide
cagcuaucuaaggcuuggu

SEQ ID NO: 1918 - RNA, 19 nt, Artificial Sequence
  Description of Artificial Sequence: Synthetic oligonucleotide
augauaccugggucuaaug

SEQ ID NO: 1919 - RNA, 19 nt, Artificial Sequence
  Description of Artificial Sequence: Synthetic oligonucleotide
aacucugcugagaucaccu

SEQ ID NO: 1920 - RNA, 19 nt, Artificial Sequence
  Description of Artificial Sequence: Synthetic oligonucleotide
accucaaguuucugcgguu

SEQ ID NO: 1921 - RNA, 19 nt, Artificial Sequence
  Description of Artificial Sequence: Synthetic oligonucleotide
uugguaaagagaacaaggg

SEQ ID NO: 1922 - RNA, 19 nt, Artificial Sequence
  Description of Artificial Sequence: Synthetic oligonucleotide
aagaacaaacaucccuuuu

SEQ ID NO: 1923 - RNA, 19 nt, Artificial Sequence
  Description of Artificial Sequence: Synthetic oligonucleotide
uuuuauugcuccaaauggu

SEQ ID NO: 1924 - RNA, 19 nt, Artificial Sequence
  Description of Artificial Sequence: Synthetic oligonucleotide
gauuuaaucccuacauggu

SEQ ID NO: 1925 - RNA, 19 nt, Artificial Sequence
  Description of Artificial Sequence: Synthetic oligonucleotide
ggugcuggguggacaaugu

SEQ ID NO: 1926 - RNA, 19 nt, Artificial Sequence
  Description of Artificial Sequence: Synthetic oligonucleotide
ugucacugucacaugccuu

SEQ ID NO: 1927 - RNA, 19 nt, Artificial Sequence
  Description of Artificial Sequence: Synthetic oligonucleotide
uucacuguauaaauccaac

SEQ ID NO: 1928 - RNA, 19 nt, Artificial Sequence
  Description of Artificial Sequence: Synthetic oligonucleotide
accuucugccagagagaau

SEQ ID NO: 1929 - RNA, 19 nt, Artificial Sequence
  Description of Artificial Sequence: Synthetic oligonucleotide
cauggagggaggauagugg

SEQ ID NO: 1930 - RNA, 19 nt, Artificial Sequence
  Description of Artificial Sequence: Synthetic oligonucleotide
aaaugauauaguuggacug

SEQ ID NO: 1931 - RNA, 19 nt, Artificial Sequence
  Description of Artificial Sequence: Synthetic oligonucleotide
acuggugcuugaugucacu

SEQ ID NO: 1932 - RNA, 19 nt, Artificial Sequence
  Description of Artificial Sequence: Synthetic oligonucleotide
cuaauaaaugaaacuguca

We claim:

1. A double stranded ribonucleic acid (dsRNA) agent for inhibiting expression of a xanthine dehydrogenase (XDH) gene,
   wherein said dsRNA agent comprises a sense strand and an antisense strand forming a double stranded region, wherein the sense strand comprises at least 15 contiguous nucleotides differing by no more than 3 nucleotides from the nucleotide sequence of nucleotides 271-309 of SEQ ID NO:1,
   wherein the dsRNA agent comprises at least one nucleotide comprising a nucleotide modification, and
   wherein the dsRNA agent further comprises a ligand.

2. The dsRNA agent of claim 1, wherein substantially all of the nucleotides of said sense strand and substantially all of the nucleotides of said antisense strand comprise a nucleotide modification.

3. The dsRNA agent of claim 2, wherein all of the nucleotides of said sense strand and all of the nucleotides of said antisense strand comprise a nucleotide modification.

4. The dsRNA agent of claim 3, wherein the modified nucleotides are independently selected from the group consisting of a deoxy-nucleotide, a 3'-terminal deoxy-thymine (dT) nucleotide, a 2'-O-methyl modified nucleotide, a 2'-fluoro modified nucleotide, a 2'-deoxy-modified nucleotide, a locked nucleotide, an unlocked nucleotide, a conformationally restricted nucleotide, a constrained ethyl nucleotide, an abasic nucleotide, a 2'-amino-modified nucleotide, a 2'-O-allyl-modified nucleotide, 2'-C-alkyl-modified nucleotide, 2'-hydroxly-modified nucleotide, a 2'-methoxyethyl modified nucleotide, a 2'-O-alkyl-modified nucleotide, a morpholino nucleotide, a phosphoramidate, a non-natural base comprising nucleotide, a tetrahydropyran modified nucleotide, a 1,5-anhydrohexitol modified nucleotide, a cyclohexenyl modified nucleotide, a nucleotide comprising a phosphorothioate group, a nucleotide comprising a methylphosphonate group, a nucleotide comprising a 5'-phosphate, and a nucleotide comprising a 5'-phosphate mimic.

5. The dsRNA agent of claim 1, wherein each strand is no more than 30 nucleotides in length.

6. The dsRNA agent of claim 1, wherein at least one strand comprises a 3' overhang of at least 1 nucleotide; or at least 2 nucleotides.

7. The dsRNA agent of claim 1, wherein the ligand is conjugated to the 3' end of the sense strand of the dsRNA agent.

8. The dsRNA agent of claim 1, wherein the ligand is an N-acetylgalactosamine (GalNAc) derivative.

9. The dsRNA agent of claim 8, wherein the ligand is

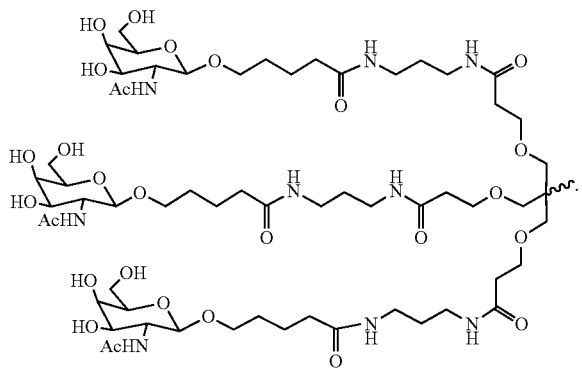 [SMILES: CC(=O)NC1C(OCCCCC(=O)NCCCNC(=O)CCOCC(C)(COCCC(=O)NCCCNC(=O)CCCCOC2OC(CO)C(O)C(O)C2NC(C)=O)COCCC(=O)NCCCNC(=O)CCCCOC2OC(CO)C(O)C(O)C2NC(C)=O)OC(CO)C(O)C1O]

10. The dsRNA agent of claim 9, wherein the dsRNA agent is conjugated to the ligand as shown in the following schematic

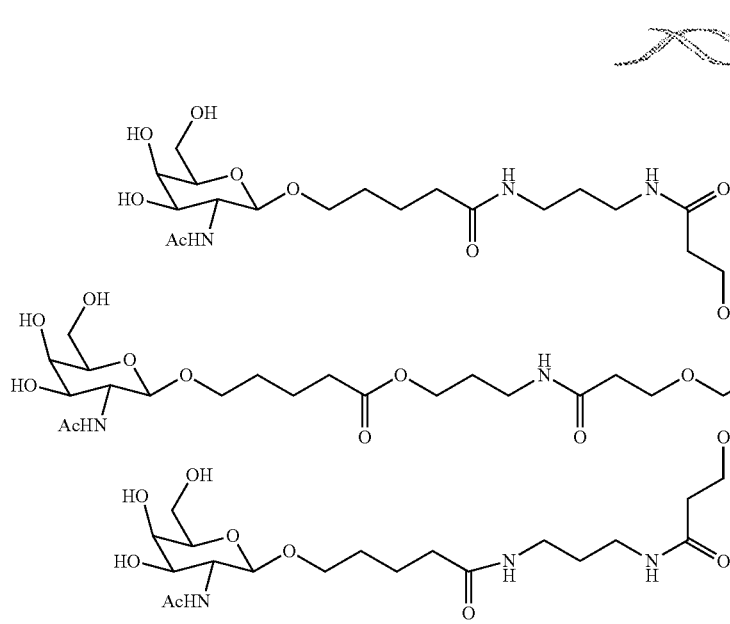
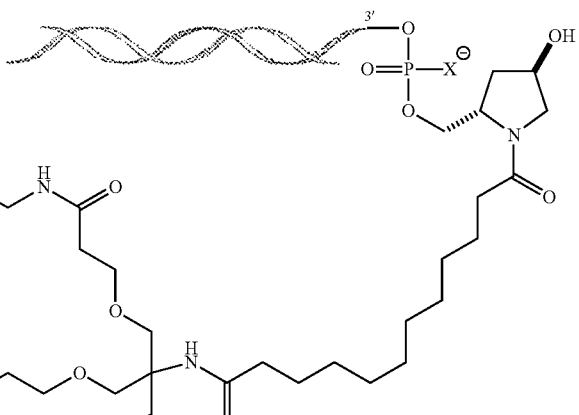

and, wherein X is O or S.

11. The dsRNA agent of claim 10, wherein X is O.

12. The dsRNA agent of claim 1, wherein the double stranded region is 17-30 nucleotide pairs in length; 17-23 nucleotide pairs in length; 17-25 nucleotide pairs in length; 23-27 nucleotide pairs in length; 19-21 nucleotide pairs in length; or 21-23 nucleotide pairs in length.

13. The dsRNA agent of claim 1, wherein each strand has 15-30 nucleotides; or 19-30 nucleotides.

14. The dsRNA agent of claim 1, wherein said agent further comprises at least one phosphorothioate or methylphosphonate internucleotide linkage.

15. A pharmaceutical composition for inhibiting expression of an XDH gene comprising the dsRNA agent of claim 1.

16. A method of inhibiting xanthine dehydrogenase (XDH) expression in a cell, the method comprising contacting the cell with the dsRNA agent of claim 1, thereby inhibiting expression of the XDH gene in the cell.

17. A method of treating a subject having a disease or disorder that would benefit from reduction in XDH expression, the method comprising administering to the subject a therapeutically effective amount of the dsRNA agent of claim 1, thereby treating said subject.

18. The dsRNA agent of claim 1, wherein the antisense strand comprises at least 17 contiguous nucleotides differing by no more than three nucleotides from the nucleotide sequence of the complement of nucleotides 271-309 of SEQ ID NO:1.

19. The dsRNA agent of claim 18, wherein the antisense strand comprises at least 17 contiguous nucleotides differing by no more than three nucleotides from any one of the nucleotide sequences selected from the group consisting of

```
                                      (SEQ ID NO:689)
5'-UUGGCAGAAAAGUGGACGA-3';
and (SEQ ID NO:690)
5'-AUGGGGGCCAGGCAGGCAU-3'.
```

20. The dsRNA agent of claim 19, wherein the sense strand and the antisense strand comprise nucleotide sequences selected from the group consisting of

```
                                      (SEQ ID NO:375)
5'-UCGUCCACUUUUCUGCCAA-3'
and (SEQ ID NO:689)
5'-UUGGCAGAAAAGUGGACGA-3';
and (SEQ ID NO:376)
5'-AUGCCUGCCUGGCCCCCAU-3'
and (SEQ ID NO:690)
5'-AUGGGGGCCAGGCAGGCAU-3'.
```

* * * * *